United States Patent
Cech et al.

(10) Patent No.: US 7,262,288 B1
(45) Date of Patent: *Aug. 28, 2007

(54) NUCLEIC ACIDS ENCODING HUMAN TELOMERASE REVERSE TRANSCRIPTASE AND RELATED HOMOLOGS

(75) Inventors: Thomas R. Cech, Boulder, MD (US); Joachim Lingner, Epalinges (CH); Toru Nakamura, San Diego, CA (US); Karen B. Chapman, Mill Valley, CA (US); Gregg B. Morin, Oakville (CA); Calvin B. Harley, Palo Alto, CA (US); William H. Andrews, Reno, NV (US)

(73) Assignees: Geron Corporation, Menlo Park, CA (US); The Regents of the University of Colorado, Boulder, CO (US)

( * ) Notice: Subject to any disclaimer, the term of this patent is extended or adjusted under 35 U.S.C. 154(b) by 311 days.

This patent is subject to a terminal disclaimer.

(21) Appl. No.: 09/721,506

(22) Filed: Nov. 22, 2000

Related U.S. Application Data

(63) Continuation of application No. 08/974,549, filed on Nov. 19, 1997, now Pat. No. 6,166,178, which is a continuation-in-part of application No. 08/915,503, filed on Aug. 14, 1997, now abandoned, and a continuation-in-part of application No. 08/912,951, filed on Aug. 14, 1997, now Pat. No. 6,475,789, and a continuation-in-part of application No. 08/911,312, filed on Aug. 14, 1997, now abandoned, which is a continuation-in-part of application No. 08/854,050, filed on May 9, 1997, now Pat. No. 6,261,836, which is a continuation-in-part of application No. 08/851,843, filed on May 6, 1997, now Pat. No. 6,093,809, which is a continuation-in-part of application No. 08/846,017, filed on Apr. 25, 1997, now abandoned, which is a continuation-in-part of application No. 08/844,419, filed on Apr. 18, 1997, now abandoned.

(30) Foreign Application Priority Data

| Oct. 1, 1997 | (WO) | PCT/US97/17618 |
| Oct. 1, 1997 | (WO) | PCT/US97/17885 |

(51) Int. Cl.
C07H 21/04 (2006.01)
C12N 9/00 (2006.01)
C12N 15/00 (2006.01)
C12N 1/20 (2006.01)

(52) U.S. Cl. .............. 536/23.5; 536/23.1; 435/183; 435/320.1; 435/252.3

(58) Field of Classification Search .............. 435/6, 435/183, 320.1, 252.3; 536/23.1, 23.5

See application file for complete search history.

(56) References Cited

U.S. PATENT DOCUMENTS

| 3,817,837 A | 6/1974 | Tanenholtz et al. |
| 3,850,752 A | 11/1974 | Schuurs et al. |
| 3,939,350 A | 2/1976 | Kronick et al. |
| 3,996,345 A | 12/1976 | Ullman et al. |
| 4,275,149 A | 6/1981 | Litman et al. |
| 4,277,437 A | 7/1981 | Maggio |
| 4,366,241 A | 12/1982 | Tom et al. |
| 4,683,195 A | 7/1987 | Mullis et al. |
| 4,683,202 A | 7/1987 | Mullis |
| 4,816,567 A | 3/1989 | Cabilly et al. |
| 4,965,188 A | 10/1990 | Mullis et al. |
| 5,489,508 A | 2/1996 | West et al. |
| 5,583,016 A | 12/1996 | Villeponteau et al. |
| 5,597,697 A | 1/1997 | Diamond |
| 5,747,317 A | 5/1998 | Cao |
| 5,770,422 A | 6/1998 | Collins |
| 5,917,025 A | 6/1999 | Collins |
| 6,093,809 A * | 7/2000 | Cech et al. ............ 536/23.5 |
| 6,166,178 A | 12/2000 | Cech et al. |
| 6,258,535 B1 | 7/2001 | Villeponteau et al. |
| 6,261,556 B1 | 7/2001 | Weinrich et al. |
| 6,261,836 B1 * | 7/2001 | Cech et al. ............ 435/325 |
| 6,309,867 B1 | 10/2001 | Cech et al. |
| 6,337,200 B1 * | 1/2002 | Morin ................... 435/194 |
| 6,440,735 B1 | 8/2002 | Gaeta |
| 6,444,650 B1 | 9/2002 | Cech et al. |
| 6,475,789 B1 * | 11/2002 | Cech et al. ............ 435/366 |
| 6,517,834 B1 | 2/2003 | Weinrich et al. |
| 6,608,188 B1 | 8/2003 | Tsuchiya et al. |
| 6,610,839 B1 | 8/2003 | Morin et al. |
| 6,617,110 B1 | 9/2003 | Cech et al. |
| 6,627,619 B2 | 9/2003 | Cech et al. |
| 6,767,719 B1 * | 7/2004 | Morin et al. ............ 435/69.1 |

(Continued)

FOREIGN PATENT DOCUMENTS

| CA | 2271718 A1 | 5/1998 |

(Continued)

OTHER PUBLICATIONS

Rhyu, "Telomers, Telomerase, and Immortality," Journal of the National Cancer Institute, Jun. 21, 1995, vol. 87, No. 12, pp. 884-894.*

(Continued)

*Primary Examiner*—Bradley L. Sisson
(74) *Attorney, Agent, or Firm*—Townsend and Townsend and Crew LLP; David J. Earp; J. Michael Schiff

(57) ABSTRACT

The invention provides compositions and methods related to human telomerase reverse transcriptase (hTRT), the catalytic protein subunit of human telomerase. The polynucleotides and polypeptides of the invention are useful for diagnosis, prognosis and treatment of human diseases, for changing the proliferative capacity of cells and organisms, and for identification and screening of compounds and treatments useful for treatment of diseases such as cancers.

9 Claims, 103 Drawing Sheets

U.S. PATENT DOCUMENTS

| | | |
|---|---|---|
| 2002/0164786 | 11/2002 | Cech et al. |
| 2002/0187471 | 12/2002 | Cech et al. |
| 2003/0009019 | 1/2003 | Cech et al. |
| 2003/0032075 | 2/2003 | Cech et al. |
| 2003/0044953 | 3/2003 | Cech et al. |
| 2003/0059787 | 3/2003 | Cech et al. |
| 2003/0096344 | 5/2003 | Cech et al. |
| 2003/0100093 | 5/2003 | Cech et al. |

FOREIGN PATENT DOCUMENTS

| | | | |
|---|---|---|---|
| GB | 2 317 891 A | | 4/1998 |
| JP | 09154575 A | | 6/1997 |
| WO | WO84/03564 | | 9/1984 |
| WO | WO93/23572 | A1 | 11/1993 |
| WO | WO94/17210 | A1 | 8/1994 |
| WO | WO95/13362 | | 5/1995 |
| WO | WO96/01835 | | 1/1996 |
| WO | WO96/12811 | | 5/1996 |
| WO | WO96/19580 | | 8/1996 |
| WO | WO98/01542 | | 1/1998 |
| WO | WO98/01549 | | 1/1998 |
| WO | WO98/06938 | | 2/1998 |
| WO | WO98/07838 | | 3/1998 |
| WO | WO98/14592 | A2 | 4/1998 |
| WO | WO98/14593 | A2 | 4/1998 |
| WO | WO98/21343 | | 5/1998 |
| WO | WO98/23759 | A2 | 6/1998 |
| WO | WO98/37181 | | 8/1998 |
| WO | WO98/45450 | | 10/1998 |
| WO | WO98/40868 | | 12/1998 |
| WO | WO98/59040 | | 12/1998 |
| WO | WO99/01560 | | 1/1999 |
| WO | WO99/33998 | A2 | 7/1999 |
| WO | WO99/38964 | A2 | 8/1999 |
| WO | WO 00/46355 | A2 | 8/2000 |

OTHER PUBLICATIONS

Martinell, J. "Calculation for Approximate Number of Embodiments in a Percent Identity Claim (Peptides)," Nov. 17, 1999.*

Adamson, D. et al. "Significant Telomere Shortening in Childhood Leukemia", *Cancer Genet. Cytogenet*, 1992; pp. 204-206, vol. 61.

Autexier, Chantal, et al., Telomerase and cancer: revisiting the telomere hypothesis; Trends in Biochemical Sciences, 1996, pp. 387-391, vol. 10, No. 21.

Avilion, A., "Characterization and expression of human telomerase," Dissertation Abstracts International, 1996, pp. 5930-B, vol. 56, No. 11.

Baringa, Marcia, "The Telomerase Picture Fills In", *Science*, Apr. 25, 1997; pp. 528-529, vol. 276.

Chiu, et al. "Replicative senescence and cell immortality: the role of telomeres and telomerase (44075)", *Proc. Soc. Exp. Bio. Med.*, 1997, pp. 99-106, vol. 214.

Chong, L. et al. "A Human Telomeric Protein", *Science*, Dec. 1995, pp. 1663-1667, vol. 270.

Collins, Kathleen, "Structure and function of telomerase", Current Opinion in Cell Biology, 1996, pp. 374-380, vol. 8.

Counter, C. et al. "Telomerase Activity in Normal Leukocytes and in Hematologic Malignancies" *Blood*; May 1, 1995; pp. 2315-2320, vol. 85, No. 9.

Counter, C. et al, "Telomere shortening associated with chromosome instability is arrested in immortal cells which express telomerase activity", *The EMBO Journal*; 1992, pp. 1921-1929, vol. 11; No. 5, Oxford University Press.

De Lange, T. et al. "Structure and Variability of Human Chromosome Ends"; *Molecular and Cellular Biology*; Feb. 1990; pp. 518-527, vol. 10, No. 2.

Flavell, R. & Mathias, R. "Prospects for transforming monocot crop plants", *Nature*, Jan. 12, 1984, pp. 108-109, vol. 307.

Freshney, *Culture of Animal Cells. A Manual Basic Technique*, p. 4, Alan R. Liss, Inc. New York, 1983.

Genbank Accession No. A46242; Sep. 21, 1993.

Genbank Accession No. L38903; Jan. 30, 1995.

Genbank Accession No. Q06163; Nov. 1, 1995.

Genbank Accession No. S39696; Oct. 7, 1994.

Genbank Accession No. S53396; May 5, 1995.

GenBank Accession No. U95964: May 5, 1997.

GenBank Accession No. W70315; Jun. 19, 1996.

Glaser, P. et al. "*Bacillus subtilis* genome project: cloning and sequencing of the 97 kb region from 325° to 333°" *Molecular Microbiology*, 1993, pp. 371-384, vol. 10, No. 2.

Goodman, R. et al. "Gene Transfer in Crop Improvement", Science, Apr. 3, 1997, pp. 48-54, vol. 236.

Greider, C. "Telomeres, Telomerase and Senescence"; *BioEssays*; 1990: pp. 363-369, vol. 12, No. 8.

Harley, C. "Telomere loss: Mitotic clock or genetic time bomb?" *Mutation Research*; 1991; pp. 271-282, vol. 256, Elsevier Science Publishers.

Harley, C. & Villeponteau, B. "Telomeres and telomerase in aging and cancer" *Current Opinion in Genetics and Development*; 1995, pp. 249-255, vol. 5.

Harley, C. et al. "Telomeres shorten during ageing of human fibroblasts", *Nature*, May 31, 1990; pp. 458-460, vol. 345.

Hastie, N. et al. "Telomere reduction in human colorectal carcinoma and with ageing", *Nature*, Aug. 30, 1990, pp. 866-868, vol. 346.

Healy, K. C. "Telomere dynamics and telomerase activation in tumor progression: prospects for prognosis and therapy" *Oncol. Res.*, 1995, pp. 121-130, vol. 7.

Henderson, C. Cancer genetics gene regulates telomerase resulting in death of cancer cells; *Gene Therapy Weekly*; Sep. 11, 1995.

Hiyama, E. et. al. "Correlating telomerase activity levels with human neuroblastoma outcomes"; *Nature Medicine*; Mar. 3, 1995; pp. 249-255, vol. 1, No. 3.

Holtzmann, K. et al. "Telomeric Associations and Loss of Telomeric DNA Repeats in Renal Tumors", *Genes, Chromosomes & Cancer*, 1993, pp. 178-181, vol. 6.

Jähne, A. et al. "Genetic Engineering of Cereal Crop Plants: A Review", Euphytica, 1995, pp. 35-44, vol. 85, Kluwer Academic Publishers, Netherlands.

Jolliffe, L.K. "Humanized antibodies: enhancing therapeutic utility through antibody engineering", *Int. Rev. Immunol.*, 1993, pp. 241-250, vol. 10.

Kim, N. et al. "Specific Association of Human Telomerase Activity with Immortal Cells and Cancer", *Science*, Dec. 23, 1994, pp. 2011-2014, vol. 266.

Klingelhutz, A. et al. "Restoration of Telomeres in Human Papillomavirus- Immortalized Human Anogenital Epithelial Cells"; *Molecular and Cellular Biology*; Feb. 1994, pp. 961-969, vol. 14, No. 2.

Lewis, A. & Crowe, J.S. "Generation of humanized monoclonal antibodies by 'best fit' framework selection and recombinant polymerase chain reaction", *Year Immunol.*, 1993, pp. 110-118, vol. 7.

Linking telomerase and tumors; *Genesis Report- Dx*; 1995; vol. 4, No. 6; Publisher Genesis Group Associates.

Lundblad, V. & Blackburn, E., Letter to the Editor entitled, "RNA-Dependent Polymerase Motifs in EST1: Tentative Identificatioin of a Protein Component of an Essential Yeast Telomerase", *Cell*, Feb. 23, 1990, pp. 529-530, vol. 60.

Lustig, Arthur J., "The identification of telomerase subunits: catalysing telomere research", Trends in Cell Biology; Aug. 1997, pp. 299-302, vol. 7.

Malicki, J. et al. "A human *HOX4B* regulatory element provides head-specific expression in *Drosophila* embryos", Nature, Jul. 23, 1992, pp. 345-357, vol. 358.

Nakayama, J. et al. "Cloning of a Candidate cDNA Encoding a Proteinaceous Component of Mammalian Telomerase", *Molecular Biology Cell Abstracts Supp 7*, 1996, p. 875-884, 286a Section 1664.

Natarajan et al. "Major histocompatibility complex determinants select T-cell receptor alpha chain variable region dominance in a peptide-specific response." *Proc. Natl. Acad. Sci.*, Oct. 1992, pp. 8874-8878, vol. 19.

Paszkowski, Jerzy et al. "Direct gene transfer to plants," The EMBO Journal, 1984, pp. 2717-2722, vol. 3, No. 12.
Potrykus, I. et al. "Direct gene transfer to cells of a graminaceous monocot", *Mol. Gen. Genet.*, 1985, pp. 183-188, vol. 199.
Raymond, E., et al.; Agents that target telomerase and telomeres; *Curr. Opin. Biotechnol.*; 1996; 7:583-91.
Rhyu, M.S. "Telomeres, telomerase, and immortality"; *J. Natl. Cancer Inst.*; Jun. 21, 1995; pp. 884-894, vol. 87, No. 12.
Schena et al. "Parallel human genome analysis: Microarray-based expression monitoring of 1000 genes", *Proc. Natl. Acad. Sci.*, Oct. 1996, pp. 10614-10619, vol. 93, USA.
Schwartz, H. et al. "Telomere Reduction in Giant Cell Tumor of Bone and with Aging"; *Cancer Genet Cytogenet*; 1993; pp. 132-138, vol. 71, Elsevier Science Publishing Co., Inc., New York, U.S.A.
Singer, M. "Unusual Reverse Transcriptases", Journal of Biological Chemistry; 1995, pp. 24623-23626, vol. 270, No. 42.
Smith, J. & Yeh, G. "Telomere Reduction in Endometrial Adenocarcinoma"; *Am. J. Obstet. Gynecol.*; Dec. 1992; pp. 1883-1887, vol. 167, No. 6.
Tait, J. et al. "Structure and Polymorphisms of the Human Annexin III (ANX3) Gene", *Genomics*, 1993, pp. 79-86, vol. 18, No. 1.
Winter, G. & Harris, W. "Humanized Antibodies", *Trends Pharmacol. Sci.*, May 1993, pp. 139-143, vol. 14.
Wirth, Urs et al; "Immediate-Early RNA 2.9 and Early RNA 2.6 of Bovine herpesvirus 1 Are 3' Coterminal and Encode of Putative Zinc Finger Transactivator Protein"; *Journal of Virology*; May 1992; pp. 2763-2772, vol. 66, No. 5.
Zaug, Arthur et al., "Method for determining RNA 3' ends and application to human telomerase RNA", *Nucleic Acids Research*, 1996, pp. 532-533, vol. 24, No. 3.
U.S. Appl. No. 08/751,189, filed Nov. 15, 1996, Harrington, et al.
U.S. Appl. No. 60/038,750, filed Feb. 20, 1997, Counter, et al.
1994 Genome Issue of *Science* (265;1981I).
Anderson and Young, "Quantitative Filter Hybridization" in *Nucleic Acid Hybridization* pp. 73-111 (1985).
Ausubel et al., Current Protocols in Molecular Biology, John Wiley & Sons, New York NY (1989).
Autexler et al., "Reconstitution of human telomerase activity and Identification of a minimal functional region of the human telomerase RNA," (1996) *EMBO J*, 15:5928.
Auxexier and Grelder, "Functional reconstitution of wild-type and mutant *Tetrahymena* telomerase." (1994) *Genes Develop.*, 8:583.
Berger and Kimmel, *Guide to Molecular Cloning Techniques*, Meth. Enzymol., vol. 152, Academic Press, San Diego CA (1967).
Blessman et al., "Addition of Telomere-Associated HeT DNA Sequences "Heals" Broken Chromosome End s in *Drosophila*," (1990) *Cell*, 61:663.
Bitter et al., "Expression and secretion vectors for yeast," Meth Enzymol., (1987) 153:516.
Blackburn and Chiou, "Non-nucleosomal packaging of a tandemly repeated DNA sequence at termini of extrachromosomal DNA coding for RNA in Tetrahymena," (1981) *Proc. Natl. Acad. Sci.*, 78:2263.
Blackburn and Gall, "A tandemly repeated sequence at the termini of the extrachromosomal ribosomal RNA genes In Tetrahymena," (1978) *J. Mol. Biol.*, 120;33.
Blackburn, "Telomerases," (1992) *Ann. Rev. Biochem.*, 81:113.
Bodnar et al., "Extension of Life-Span by Introduction of Telomerase Into Normal Human Cells," (1998) *Science*, 279:349.
Bradford, "A Rapid and Sensitive method for the Quantitation of Microgram Quantities of Protein Utilizing the Principle of Protein-Dye Binding," (1976) *Anal. Biochem.*, 72:248.
Braunstein et al., "Transcriptional silencing in yeast is associated with reduced nucleosome acetylation," (1993) *Genes Develop.*, 7:592.
Calvio et al., "Identification of hnRNP P2 as TLS/FUS using electrospray mass spectrometry," (1995) *RNA*, 1:724.
Caruthers et al., "New chemical methods for synthesizing polynucleotides," (1980) *Nucleic Acids Res. Symp. Ser.*, 215-223.
Chen and Tye, "Organization of DNA sequences and replication origins at yeat telomeres," (1983) *Cell*, 33:563.

Colbere-Gerapin et al., "A new dominat hybrid selective marker for higher eukaryotic cells," (1981) *J. Mol. Biol.*, 150:1.
Cole et al., "The EBV-hybridoma technique and its application to human lung cancer," Monoclonal Antibodies and Cancer Therapy, Alan R. Liss Inc., New York NY 77-96 (1985).
Collins et al., "Purification of Tetrahymena telomerase and cloning of genes encoding the two peotein components of the enzyme," (1995) *Cell*, 81:877.
Conrad et al., "RAP1 protein interacts with yeast telomers in vivo: Overproduction alters telomere structure and decreases chromosome stability," (1990) Cell, 63:739.
Coombe, *Dictionary of Biotechnology*, Stockton Press, New York NY (1994).
Coto et al., "Generation of human monoclonal antibodies reactive with cellular antigens," (1983) *Proc. Natl. Acad. Sci.*, 80:2026.
Counter et al., "The catalytic subunit of yeast telomerase," (1997) *Proc. Natl. Acad. Sci.*, 94:9202.
Counter et al., (1994) *Proc. Natl. Acad. Sci.*, 91:2900.
Creighton, *Proteins, Structures and Molecular Principles*, WH Freeman and Co, New York, NY (1983).
Dieffenbach and Dveksier, *PCR Primer, a Laboratory Manual*, Cold Spring Harbor Press, Plainview NY (1995).
Duplaa et al., "Quantitative analysis of polymerase chain reaction products using biotinylated dUTP Incorporation," (1993) *Anal. Biochem.*, 212:229.
Feng et al., "Oxytricha telomere-binding protein: separable DNA-binding and dimerization domains of the α-subunit," Genes Develop. 7:870 (1993) and Gray et al., (1991) Cell 67:807.
Feng et al., "The RNA Component of Human Telomerase," (1995) *Science*, 269:1236.
GenBank Accession No. AA281296.
Genbank accession No. AA299878.
Genbank accession No. AA311750.
Gilley et al., "Altering specific telomerase RNA template residues affects active site function," (1995) *Genes Develop.*, 9:2214.
Gottschling and Cech, "Chromatin Structure of the Molecular Ends of Oxytricha Mononuclear DNA: Phased Nucleosomes and a Telomeric Complex," (1984) *Cell*, 38:501.
Gottschling and Zekian, "Telomere proteins: specific recognition and protection of the natural termini of Oxytricha macronuclear DNA," (1986) *Cell* 47:195.
Grant et al., Meth Enzymol., (1987) 153:516-544.
Greenwood et al., "Phylogenetic relationships within the class oligohymenophorea, phylum ciliophora, inferred from the complete small subunit rRNA gene sequences of *Colpidium campylum, Glaucoma chattoni,* and *Opisthanecta henneguyi*," (1991) *J, Mol. Evol.*, 3:163.
Greider and Blackburn, "A telomeric sequence in the RNA of Tetrahymena telomerase required for telomere repeat synthesis," (1989) *Nature*, 337:331.
Greider and Blackburn, "Identification of a specific telomere terminal transferase activity on Tetrahymena extracts," (1985) *Cell*, 43:405.
Greider, "Telomerase is processive," (1991) *Mol. Cell. Biol.*, 11:4572.
Greider, "Telomere Length Regulation," (1985) *Ann. Rev. Biochem.*, 65:337.
Hampton et al., *Serological Methods a Laboratory Manual*, APS Press, St Paul MN (1990).
Harrington et al., "A Mammalian Telomerase-Associated Protein," (1997) *Science*, 275:973.
Harrington et al., "Human telomerase contains evolutionarily conserved catalytic and structural subunits," (1987) *Genes Dev.*, 11:3109.
Hartman and Mulligan, "Two dominant-acting selectable markers for gene transfer studies in mammalian cells," (1988) *Proc. Natl. Acad. Sci.*, 85:8047.
Henderson and Blackburn, "An overhanging 3' terminus is a conversed feature of telomeres," (1989) *Mol Cell. Biol.*, 9:345.
Horn et al., "Synthesis of oligonucleotides on cellulose. Part II: design and synthetic strategy to the synthesis of 22 oligodeoxynucleotides coding for gastric inhibitory polypeptide (GIP)," (1980) *Nucleic Acids Res. Symp. Ser.*, 225-232.

Hudson et al., "An STS-based map of the human genome," (1995) *Science*, 270:1946.

Huse et al., "Generation of a large combinatorial library of the immunoglobulin repertoire in phage lambda," (1989) *Science*, 246:1275.

Johnson et al., (1991) Mol. Cell Biol. 11:1.

Kiljian et al., "Isolation of a candidate human telomerase catalytic subunit gene, which reveals complex splicing patterns in different cell types," (1997) *Hum. Mol. Genet.*, 6;2011.

Kipling and Cooke, "Hypervariable ultra-long telomeres in mice." (1990) *Nature* 347:400.

Klobutcher et al., "All gene-sized DNA molecules in four species of hypotrichs have the same terminal sequence and an unusual 3' terminus,", (1981) *Proc. Natl. Acad. Sci.*, 78:3015.

Koehler and Milstein, "Continuous cultures of fused cells secreting antibody of predefined specificity," (1975) *Natura* 256:495.

Kaspor et al., "The production of monoclonal antibodies from human lymphocytes," (1983) Immunol. Today 4:72.

Lamond and Sproat. (1994)"Isolation and Characterization of Ribonucleoprotein Complexes," pp. 103-140.

Lamond et al., "Probing the structure and function of U2 enRNF with antisense oligonucleotides made of 2'-OM-RNA," (1969) *Cell*, 58:363.

Londvay et al., "Senescence mutants of *Saccharomyces cerevisiae* with a defect in telomere replication identify three additional EST genes," (1998) *Genetics*, 144.

Lingler et al., "Purification of telomerase from *Euplotes adelculatus*: requirement of a primer 3' overhang," (1996) *Proc. Natl. Acad. Sci.*, 93:10712.

Lingler et al., "Reverse transcriptase motifs in the catalytic subunit of telomerase," (1997) *Science*, 276:561.

Lingner et al., "Telomerase RNAs of different ciliates have a common secondary structure and a permuted template," (1994) *Genes Develop.*, 8:1984.

Lingner et al., "Telomerase and DNA End Replication: No Longer a Lagging Strand Problem?," (1995) *Science* 289:1533.

Lowy et al., "Isolation of transforming DNA: Cloning the hamster aprt gene," (1980) *Cell*, 22:817.

Lustig and Patas, Identification of yeast mutants with altered telomere structure, (1986) *Proc. Natl. Acad. Sci.*, 83:1398.

Maddox et al., "Elevated serum levels in human pregnancy of a molecule immunochemically similar to eosinophil granule major basic protein," (1983) *J. Exp. Med.*, 158:1211.

Makarov et al., "Nucleosomal Organization of Telomere-Specific Chroamtin in Rat," (1993) Cell, 73:775.

McEachem and Blackburn, "runaway telomere elongation caused by telomerase RNA gene mutation," (1995) *Nature*, 378:403.

Melby et al., "Quantitative measurement of human cytokine gene expression by polymerase chain reaction," (1993) *J. Immunol. Meth.*, 159:235.

Merrifield, "Solid phase peptide synthesis. I. The synthesis of a tetrapeptide," (1983) *J. Am. Chem. Soc.*, 85:2149.

Meyerson et al., "hEST2, the Putative Human Telomerase Catalytic Subunit Gene, Is Up-Regulated in Tumor Cells and during Immortalization," (1997) *Cell*, 90:785.

Murray, *In McGraw Hill Yearbook of Science and Technology*, (1992) McGraw Hill, New York NY, pp. 191-196.

Nakamura et al., "Telomerase Catalytic Subunit Homologs from Fission Yeast and Human," (1997) *Science*, 277:955.

Nakayama et al., "TLP1: A Gene Encoding a Protein Component of Mammalian Telomerase Is a Novel Member of WD Repeats Family," (1997) *Cell*,88:875.

Nielsen et al., (1993) "Peptide nucleic acids (PNAs): Potential antisense and anti-gene agents." *Anticancer Drug Des.*, 8:53.

Oka et al., "Inverted terminal repeat sequence in the macronuclear DNA of *Stylonychia pustulata*," (1980) *Gene*, 10:301.

Olovnikov, "A theory of marginotomy: The incomplete copying of template margin in enzymic synthesis of polynucleotides and biological significance of the phenomenon," (1973) *J. Theor. Biol.*, 41:181.

Orlandl et al., "Cloning Immunoglobulin variable domains for expression by the polymerase chain reaction," (1989) *Proc. Natl. Acad. Sci.*, 88:3833.

Prescott, "The DNA of ciliated protozoa," (1994) *Microbiol. Rev.*, 58:233.

Price, (1993) *Blood Rev.*, 7:127.

Rhodes et al., "Transformation of maize by electroporation of embryos," (1995) *Meth. Mol. Biol.*, 55:121.

Roberge et al., "A strategy for a convergent synthesis of N-linked glycopeptides on a solid support," (1995) *Science*, 269:202.

Romero and Blackburn, "A conserved secondary structure for telomerase RNA," (1991) *Cell*, 87:343.

Sambrook et al., Molecular Cloning, A Laboratory Manual, Cold Spring Harbor Press, Plainview NY (1989).

Sandall et al., "Transcription of yeast telomere alleviates telomere position effect without affecting chromosome stability," (1994) *Proc. Natl. Acad. Sci.*, 91:12061.

Sanger et al., "DNA sequencing with chain-terminating inhibitors," (1977) *Proc. Natl. Acad. Sci.*, 74:5463.

Scharf et al., "Heat stress promoters and transcription factors," (1994) *Result Probl. Cell Differ.* 20:125.

Shampay and Blackburn, "Generation of telomere-length heterogeneity in *Saccharomyces cerevisiae*," (1988) *Proc. Natl. Acad. Sci.*, 65:534.

Sheen and Lovis, "Transposition of the LINE-like retrotransposon TART to *Drosophila* chromosome termini," (1994) *Proc. Natl. Acad. Sci.*, 91:12510.

Singer and Gottschling, "TLC1: Template RNA Component of *Saccharomyces cerevisiae* Telomerase," (1994) Science 266:404.

Sterling et al., "Extensive telomere repeat arrays in mouse are hypervariable," (1990) *Nucleic Acids Res.*, 18:6881.

Swanton et al., "Arrangement of Coding and Non-coding Sequences in the DNA Molecules Coding for rRNAs in *Oxytricha* sp.," (1980) *Chromosoma* 77:203.

Tommerup et al., "Unusual chromatin in human telomeres," (1994) *Mol. Cell. Biol.*, 14:5777.

Trask, "Fluorescence In situ hybridization: application in cytogenetics and gene mapping," (1991) *Trends Genet.*, 7:149.

Verma et al., "*Human Chromosomes: A Manual of Basic Techniques*," Pergamon Press, New York NY (1998).

Watson, "Origin of concatermeric T7 DNA," (1972) *Nature New Biol.*, 239:197.

Weinrich et al., "Reconstitution of human telomerase with the template RNA component hTR and the catalytic protein subunit hTRT," (1997) *Nat. Genet.*, 17(4):408.

Wellinger et al., "Origin activation and formation of single-strand $TG_{1-3}$ tails occur sequentially in late S phase on a Yeast linear plasmid," (1993) *Mol. Cell. Biol.*, 73:4057.

Wellinger et al., "*Saccharomyces* Telomeres Acquire Single-Strand $TG_{1-3}$ Tails Late in S Phase," (1993) *Cell* 72:61.

Whitehead Institute/MIT Center for Genome Research, Genetic Map of the Mouse, Database Release 10, Apr. 28, 1995.

Wigler et al., "Transfer of purified herpes virus thymidine kinase gene to cultured mouse cells," (1977) *Cell*, 11:223.

Wigler et al., "Transformation of mammalian cells with an amplifiable dominant-acting gene," (1980) *Proc. Natl. Acad. Sci.*, 77:3587.

Winter and Milstein, "Man-made antibodies," (1991) Nature, 349:293.

Wright et al., "*Saccharomyces* telomeres assume a non-nucleosomal chromatin structure," (1992) *Genes Develop.*, 6:197.

Yu et al., "In vivo alteration of telomere sequences and senescence caused by mutated Tetrahymena telomerase RNAs," (1990) *Nature*, 344:126.

Zehler and Prescott, "Telomere terminal transferase activity in the hypotrichous ciliate *Oxytricha nova* and a model for replication of the ends of linear DNA molecules," (1968) *Nucleic Acids Res.*, 16:6953.

Zaklan, Telomeres: Beginning to Understand the End, (1995) *Science* 270:1601.

Zaug et al., "Catalysis of RNA Cleavage by a Ribozyme Derived from the Group 1 Intron of Anabaena Pre-tRNA$^{Lau}$,".

Declaration under 37 CFR § 1.56 listing other issued patents and pending applications for telomerase reverse transcriptase.

U.S. Appl. No. 09/432,503, Cech et al.

U.S. Appl. No. 09/721,477, Cech et al.

U.S. Appl. No. 09/974,584, Cech et al.

Adams, Mark et al. "Initial Assessment of Human Gene Diversity and Expression Patterns Based Upon 83 Million Nucleotides of cDNA Sequence" *The Genome Directory: Supplement to Nature* Sep. 28, 1995, pp. 3-174, vol. 377, Issue 6547S.

Anderson, W. French "Human Gene Therapy" *Nature*, Apr. 30, 1998, pp. 25-30, vol. 392, Supp.

Campbell, Keith & Wilmut, Ian "Totipotency or Multipotentiality of Cultured Cells: Applications and Progress" Theriogenology, Jan. 1997, pp. 63-72, vol. 47, Issue 1, Elsevier Science Inc.

Gearhart, John "New Potential for Human Embryonic Stem Cells" *Science*, Nov. 6, 1998; pp. 1061-1062, vol. 282, Issue 5391.

Hornsby, PJ et al. "Adrenocortical Cells Immortalized by Telomerase: Potential Use for Ex Vivo Gene Therapy" Journal of Anti-Aging Medicine, 2000, pp. 411-417, vol. 3, No. 4.

Ostler Elizabeth L. et al. "Telomerase and the Cellular Lifespan: Implications for the Aging Process" J. of Pediatric Endocrinology & Metabolism, 2000, pp. 1467-1476, vol. 13, Supplement 6, Freund Publishing House Ltd. London.

Thomson, James A. et al. "Embryonic Stem Cell Lines Derived from Human Blastocysts" *Science*, Nov. 6, 1998; pp. 1145-1147, vol. 282, Issue 5391.

* cited by examiner

```
                                                     Motif 0
human    ISEIEWLVLGKRSNAKMCLSDFEKRKQIFAEFIYWLYNSFIIPILQSFFYITESSDLRNR
tez1     LKDFRWLFISD---IWFTKHNFENLNQLAICFISWLFRQLIPKIIQTFFYCTEISSTVT-
EST2                                               AKFLHWLMSVYVVELLRSFFYVTETTFQKNR
p123     TREISWMQVET-SAKHFYYFDHEN-IYVLWKLLRWIFEDLVVSLIRCFFYVTEQQKSYSK
                                                   ...:..**  *** **

Motif 1
human    LFFYRKSVWSKLQSIGIRQHLKRVQLRDVSEAEVRQHREARPALLTSRLRFIPKP--DGL
tez1     TVYFRKDIWKLLCRPFI-TSMKMEAFEKINENNVRMDTQK-TTLPPAVIRLLPKK--NTF
EST2     IVYFRHDTWNKLITPFIVEYFKTYLVENNVCRNHNSYTLS--NFNHSKMRIIPKSNNEF
p123     TYYYRKNIWDVIMKMSI-ADLKETLAEVQEKEVEEWKKS-LGFAPGKLRLIPKK--TTF
          :.*. *     .  :              .   .          *   *     **

Motif 2
human    RPIVNMDYVVGARTFRREKRAERLTSRVKALF-SVLNYERA
tez1     RLITN-LRKRFLIKMGSNKKMLVSTNQTLRPVASILKHLINEESSGIPFNLEVYMKLLTF
EST2     RIIAIPCRGADEEFTIYKENHKNAIQPTQKILEYLRNKRPTSFTKIYSPTQIADRIKEF
p123     RPIMTFNKKIVNSDRKTTKLTNTKLLNSHLMLKTLKN-RMFKDPFGAVFNYDDVMKKY
         *    :      *   :  ::  *  :         *

Motif 3 (A)
human    KKDLLKHRMFGR-KKYFVRIDIKSCYDRIKQDLMFRIVKK-KLKDPEFVIRKYATIHATS
tez1     KQRLLKKFNNVLPELYFMKFDVKSCYDSIPRMECMRILKD-ALKNENGFFVRSQYFFNTN
EST2     EEFVCKWKQVGQPKLFFATMDIEKCYDSVNREKLSTFLKTTKLLSSDFWIMTAQILKRKN
p123
         :   * .     .    :  .: *** :     : :         ...   : : :

FIG. 1
```

THUMB  PALM  FINGERS

FIG. 4

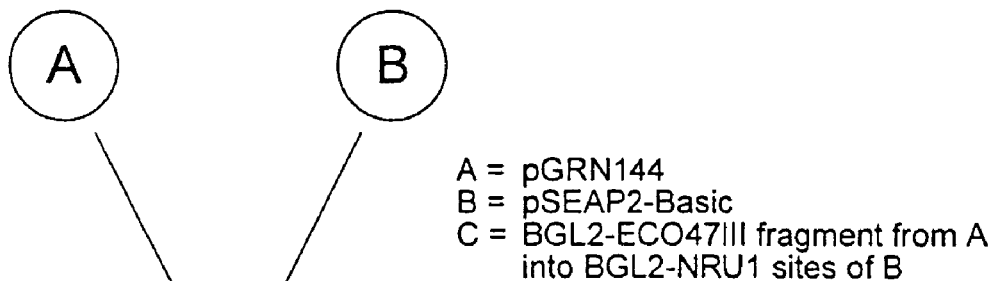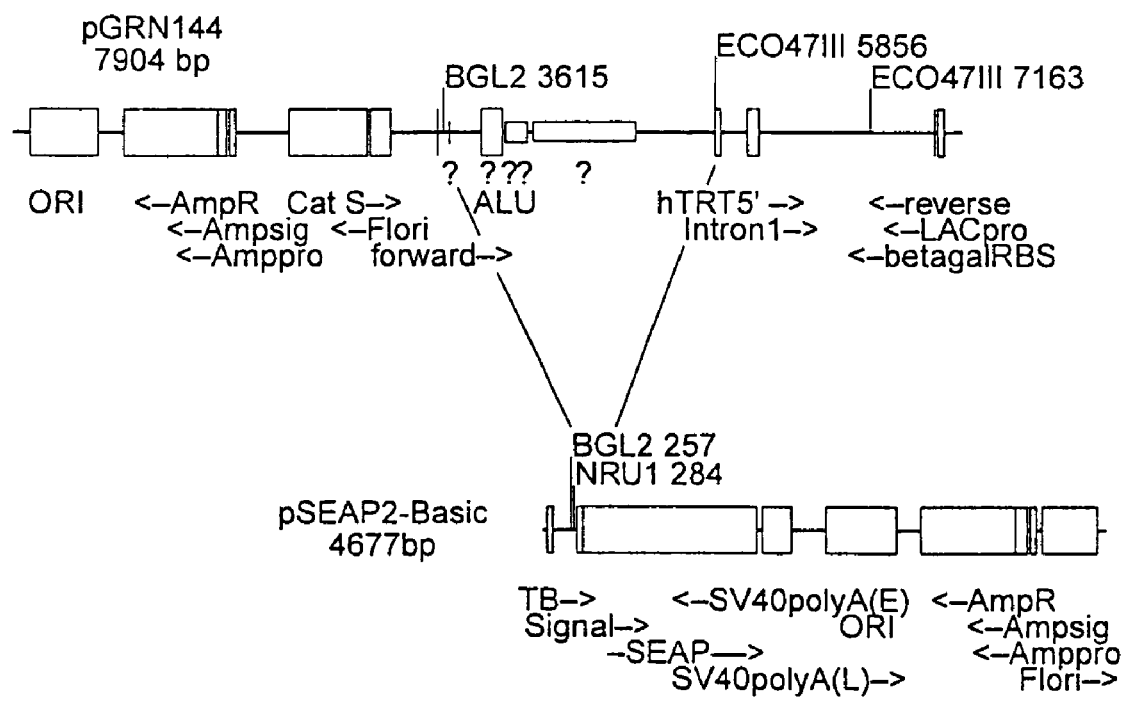
FIG. 9

Telomerase Specific Motifs

```
                    MOTIF T                                    MOTIF T'
            wl      FFY TE       y Rk  W    l      I           E   V
TRT con
hTRT    546 WLMSVYYVELLRSFFYVTETTFQKNRLFFYRKSVWSKLQSIGI  13  EAEVR
spTRT   429 WLYNSFIIPILQSFFYITESSDLRNRTVYFRKDIWKLLCRPFI  12  ENNVR
Ea_p123 441 WIFEDLVVSLIRCFFYVTEQQKSYSKTYYYRKNIWDVIMKMSI  12  EKEVE
Sc_Est2 366 WLFRQLIPKIIQTFFFYCTEISSTVT.IVYFRHDTWNKLITPFI   9  ENNVC
```

Telomerase RT Motifs (Fingers)

```
            MOTIF 1        MOTIF 2              MOTIF A                         MOTIF B'
            R  iPkk        fR  I         p  lyF  D   cYD i               Y  q  GipQGs  lS     l         y
TRT con
hTRT     11 SRLRFIPKPDG  0 LRPIV     69 PELYFVKVDVTGAYDTI 104 YVQCQGIPQGSILSTLLCSLCY
spTRT    10 AVIRLLPKKNT  0 FRLIT     66 RKKYFVRIDIKSCYDRI  99 YLQKVGIPQGSILSSFLCHFYM
Ea_p123  10 GKLRLIPKKTT  0 FRPIM     67 PKLFFATMDIEKCYDSV 117 YKQTKGIPQGLCVSSILSSFYY
Sc_Est2  13 SKMRIIPKKSN  2 FRIIA     68 PELYFMKFDVKSCYDSI  85 YIREDGLFQGSSLSAPIVDLVY
RT con      p hh h K      hR h                h  hDh AF  h                hPQG      pP hh     h
                                              GY
```

Telomerase RT Motifs (Palm, Primer Grip)

```
            MOTIF C               MOTIF D                     MOTIF E
            lllrl DDfL it         g        n   K              w  g  s       l
TRT con
hTRT     15 LLLRLVDDFLLVT     15 GVPEYGCVVNLRKTVV  24 WCGLLLDTRTL     192
spTRT    16 VLLRVVDDFLFIT     15 GFEKHNFSTSLEKTVI  22 FFGFSVNMRSL     176
Ea_p123  24 LLMRLTDDYLLIT     15 VSRENGFKFNMKKLQT  28 WIGISIDMKTL     174
Sc_Est2  18 LILKLADDFLIIS     15 GFQKYNAKANRDKILA  25 WKHSSTMNNFH     141
RT con      h  Y DDhhh           Gh h  cK  h       hLG  h
            F
```

FIG. 11

```
181 GGACCCGGCGGCTTTCCGCGCGCTGGTGGCCCAGTGCCTGGTGTGCGTGCCCTGGGACGC
    CCTGGGCCGCCGAAAGGCGCGCGACCACCGGGTCACGGACCACACGCACGGGACCCTGCG

NFkB_CS1
                                       GGGRQTYYQC
                                       NFkB-MHC-I.2
                                       TGGGCTTCCCC
                            ***********************
241 ACGGCCGCCCCCCGCCGCCCCCTCCTTCCGCCAGGTGGGCCTCCCCGGGGTCGGCGTCCG
    TGCCGGCGGGGGGCGGCGGGGGAGGAAGGCGGTCCACCCGGAGGGGCCCCAGCCGCAGGC

Intron1
    ************************************************************
301 GCTGGGGTTGAGGGCGGCCGGGGGGAACCAGCGACATGCGGAGAGCAGCGCAGGCGACTC
    CGACCCCAACTCCCGCCGGCCCCCCTTGGTCGCTGTACGCCTCTCGTCGCGTCCGCTGAG NFkB_CS1
           GGGRQTYYQC
            NFkB_CS2
           RGGGRMTYYCC
             Topo_II_cleavage_site
           RNYNNCNNGYNGKTNYNY
    ***************>
361 AGGGCGCTTCCCCCGCAGGTGTCCTGCCTGAAGGAGCTGGTGGCCCGAGTGCTGCAGAGG
    TCCCGCGAAGGGGCGTCCACAGGACGGACTTCCTCGACCACCGGGCTCACGACGTCTCC
```

*FIG. 12*

```
   1  AAAACCCCAA AACCCCAAAA CCCCTTTTAG AGCCCTGCAG TTGGAAATAT
  51  AACCTCAGTA TTAATAAGCT CAGATTTTAA ATATTAATTA CAAAACCTAA
 101  ATGGAGGTTG ATGTTGATAA TCAAGCTGAT AATCATGGCA TTCACTCAGC
 151  TCTTAAGACT TGTGAAGAAA TTAAAGAAGC TAAAACGTTG TACTCTTGGA
 201  TCCAGAAAGT TATTAGATGA AGAAATCAAT CTCAAAGTCA TTATAAAGAT
 251  TTAGAAGATA TTAAAATATT TGCGCAGACA AATATTGTTG CTACTCCACG
 301  AGACTATAAT GAAGAAGATT TTAAAGTTAT TGCAAGAAAA GAAGTATTTT
 351  CAACTGGACT AATGATCGAA CTTATTGACA AATGCTTAGT TGAACTTCTT
 401  TCATCAAGCG ATGTTTCAGA TAGACAAAAA CTTCAATGAT TTGGATTTCA
 451  ACTTAAGGGA AATCAATTAG CAAAGACCCA TTTATTAACA GCTCTTTCAA
 501  CTCAAAAGCA GTATTTCTTT CAAGACGAAT GGAACCAAGT TAGAGCAATG
 551  ATTGGAAATG AGCTCTTCCG ACATCTCTAC ACTAAATATT TAATATTCCA
 601  GCGAACTTCT GAAGGAACTC TTGTTCAATT TTGCGGGAAT AACGTTTTG
 651  ATCATTTGAA AGTCAACGAT AAGTTTGACA AAAAGCAAAA AGGTGGAGCA
 701  GCAGACATGA ATGAACCTCG ATGTTGATCA ACCTGCAAAT ACAATGTCAA
 751  GAATGAGAAA GATCACTTTC TCAACAACAT CAACGTGCCG AATTGGAATA
 801  ATATGAAATC AAGAACCAGA ATATTTATT GCACTCATTT TAATAGAAAT
 851  AACCAATTCT TCAAAAAGCA TGAGTTTGTG AGTAACAAAA ACAATATTTC
 901  AGCGATGGAC AGAGCTCAGA CGATATTCAC GAATATATTC AGATTTAATA
 951  GAATTAGAAA GAAGCTAAAA GATAAGGTTA TCGAAAAAAT TGCCTACATG
1001  CTTGAGAAAG TCAAAGATTT TAACTTCAAC TACTATTTAA CAAAATCTTG
1051  TCCTCTTCCA GAAAATTGGC GGGAACGGAA ACAAAAAATC GAAAACTTGA
1101  TAAATAAAAC TAGAGAAGAA AAGTCGAAGT ACTATGAAGA GCTGTTTAGC
1151  TACACAACTG ATAATAAATG CGTCACACAA TTTATTAATG AATTTTCTA
1201  CAATATACTC CCCAAAGACT TTTTGACTGG AAGAAACCGT AAGAATTTTC
1251  AAAAGAAAGT TAAGAAATAT GTGGAACTAA ACAAGCATGA ACTCATTCAC
1301  AAAAACTTAT TGCTTGAGAA GATCAATACA AGAGAAATAT CATGGATGCA
1351  GGTTGAGACC TCTGCAAAGC ATTTTTATTA TTTTGATCAC GAAAACATCT
1401  ACGTCTTATG GAAATTGCTC CGATGGATAT TCGAGGATCT CGTCGTCTCG
1451  CTGATTAGAT GATTTTTCTA TGTCACCGAG CAACAGAAAA GTTACTCCAA
1501  AACCTATTAC TACAGAAAGA ATATTTGGGA CGTCATTATG AAAATGTCAA
1551  TCGCAGACTT AAAGAAGGAA ACGCTTGCTG AGGTCCAAGA AAAAGAGGTT
1601  GAAGAATGGA AAAAGTCGCT TGGATTTGCA CCTGGAAAAC TCAGACTAAT
1651  ACCGAAGAAA ACTACTTTCC GTCCAATTAT GACTTTCAAT AAGAAGATTG
1701  TAAATTCAGA CCGGAAGACT ACAAAATTAA CTACAAATAC GAAGTTATTG
1751  AACTCTCACT TAATGCTTAA GACATTGAAG AATAGAATGT TTAAAGATCC
1801  TTTTGGATTC GCTGTTTTTA ACTATGATGA TGTAATGAAA AAGTATGAGG
1851  AGTTTGTTTG CAAATGGAAG CAAGTTGGAC AACCAAAACT CTTCTTTGCA
1901  ACTATGGATA TCGAAAAGTG ATATGATAGT GTAAACAGAG AAAAACTATC
1951  AACATTCCTA AAAACTACTA AATTACTTTC TTCAGATTTC TGGATTATGA
2001  CTGCACAAAT TCTAAAGAGA AAGAATAACA TAGTTATCGA TTCGAAAAAC
2051  TTTAGAAAGA AAGAAATGAA AGATTATTTT AGACAGAAAT TCCAGAAGAT
2101  TGCACTTGAA GGAGGACAAT ATCCAACCTT ATTCAGTGTT CTTGAAAATG
2151  AACAAAATGA CTTAAATGCA AGAAAACAT TAATTGTTGA AGCAAAGCAA
2201  AGAAATTATT TTAAGAAAGA TAACTTACTT CAACCAGTCA TTAATATTTG
2251  CCAATATAAT TACATTAACT TTAATGGGAA GTTTTATAAA CAAACAAAAG
2301  GAATTCCTCA AGGTCTTTGA GTTCATCAA TTTTGTCATC ATTTTATTAT
2351  GCAACATTAG AGGAAAGCTC CTTAGGATTC CTTAGAGATG AATCAATGAA
```

*FIG. 13A*

```
2401  CCCTGAAAAT  CCAAATGTTA  ATCTTCTAAT  GAGACTTACA  GATGACTATC
2451  TTTTGATTAC  AACTCAAGAG  AATAATGCAG  TATTGTTTAT  TGAGAAACTT
2501  ATAAACGTAA  GTCGTGAAAA  TGGATTTAAA  TTCAATATGA  AGAAACTACA
2551  GACTAGTTTT  CCATTAAGTC  CAAGCAAATT  TGCAAAATAC  GGAATGGATA
2601  GTGTTGAGGA  GCAAATATT   GTTCAAGATT  ACTGCGATTG  GATTGGCATC
2651  TCAATTGATA  TGAAAACTCT  TGCTTTAATG  CCAAATATTA  ACTTGAGAAT
2701  AGAAGGAATT  CTGTGTACAC  TCAATCTAAA  CATGCAAACA  AGAAAGCAT
2751  CAATGTGGCT  CAAGAAGAAA  CTAAAGTCGT  TTTTAATGAA  TAACATTACC
2801  CATTATTTTA  GAAAGACGAT  TACAACCGAA  GACTTTGCGA  ATAAAACTCT
2851  CAACAAGTTA  TTTATATCAG  GCGGTTACAA  ATACATGCAA  TGAGCCAAAG
2901  AATACAAGGA  CCACTTTAAG  AAGAACTTAG  CTATGAGCAG  TATGATCGAC
2951  TTAGAGGTAT  CTAAAATTAT  ATACTCTGTA  ACCAGAGCAT  TCTTTAAATA
3001  CCTTGTGTGC  AATATTAAGG  ATACAATTTT  TGGAGAGGAG  CATTATCCAG
3051  ACTTTTTCCT  TAGCACACTG  AAGCACTTTA  TTGAAATATT  CAGCACAAAA
3101  AAGTACATTT  TCAACAGAGT  TTGCATGATC  CTCAAGGCAA  AGAAGCAAA
3151  GCTAAAAAGT  GACCAATGTC  AATCTCTAAT  TCAATATGAT  GCATAGTCGA
3201  CTATTCTAAC  TTATTTTGGA  AAGTTAATTT  TCAATTTTTG  TCTTATATAC
3251  TGGGGTTTTG  GGGTTTTGGG  GTTTTGGGG
```

FIG. 13B

```
   1  MEVDVDNQAD  NHGIHSALKT  CEEIKEAKTL  YSWIQKVIRC  RNQSQSHYKD
  51  LEDIKIFAQT  NIVATPRDYN  EEDFKVIARK  EVFSTGLMIE  LIDKCLVELL
 101  SSSDVSDRQK  LQCFGFQLKG  NQLAKTHLLT  ALSTQKQYFF  QDEWNQVRAM
 151  IGNELFRHLY  TKYLIFQRTS  EGTLVQFCGN  NVFDHLKVND  KFDKKQGGA
 201  ADMNEPRCCS  TCKYNVKNEK  DHFLNNINVP  NWNNMKSRTR  IFYCTHFNRN
 251  NQFFKKHEFV  SNKNNISAMD  RAQTIFTNIF  RFNRIRKKLK  DKVIEKIAYM
 301  LEKVKDFNFN  YYLTKSCPLP  ENWRERKQKI  ENLINKTREE  KSKYYEELFS
 351  YTTDNKCVTQ  FINEFFYNIL  PKDFLTGRNR  KNFQKKVKKY  VELNKHELIH
 401  KNLLLEKINT  REISWMQVET  SAKHFYYFDH  ENIYVLWKLL  RWIFEDLVVS
 451  LIRCFFYVTE  QQKSYSKTYY  YRKNIWDVIM  KMSIADLKKE  TLAEVQEKEV
 501  EEWKKSLGFA  PGKLRLIPKK  TTFRPIMTFN  KKIVNSDRKT  TKLTTNTKLL
 551  NSHLMLKTLK  NRMFKDPFGF  AVFNYDDVMK  KYEEFVCKWK  QVGQPKLFFA
 601  TMDIEKCYDS  VNREKLSTFL  KTTKLLSSDF  WIMTAQILKR  KNNIVIDSKN
 651  FRKKEMKDYF  RQKFQKIALE  GGQYPTLFSV  LENEQNDLNA  KKTLIVEAKQ
 701  RNYFKKDNLL  QPVINICQYN  YINFNGKFYK  QTKGIPQGLC  VSSILSSFYY
 751  ATLEESSLGF  LRDESMNPEN  PNVNLLMRLT  DDYLLITTQE  NNAVLFIEKL
 801  INVSRENGFK  FNMKKLQTSF  PLSPSKFAKY  GMDSVEEQNI  VQDYCDWIGI
 851  SIDMKTLALM  PNINLRIEGI  LCTLNLNMQT  KKASMWLKKK  LKSFLMNNIT
 901  HYFRKTITTE  DFANKTLNKL  FISGGYKYMQ  CAKEYKDHFK  KNLAMSSMID
 951  LEVSKIIYSV  TRAFFKYLVC  NIKDTIFGEE  HYPDFFLSTL  KHFIEIFSTK
1001  KYIFNRVCMI  LKAKEAKLKS  DQCQSLIQYD  A
```

FIG. 14

```
   1 ggtaccgatttacttcctctcttcataagctaattgcttcctcgaacgctcctaaatctctggaaatctcttttacaaga    80
  81 actcaatataaggacaaaagaacaactccctccgtgtttagttgatcgataaatctcttactttttcaattttcg       160
 161 ccaagtataaggacaaaagaacaactcctccgtgtttagctgctactcctaaagactttactttattacttcttcaccccgtcattggatat   240
 241 ggttcgcttacttttaatcgtggtagctcacagaaatcctctagcgactatattggtgttctctagcccgtatgtatatttacacatggatat 320
 321 agctcttggagtagctcacagaaatcctctagcgactatattggtgttctctagcgagtgagtattgttttatttatttatttatttataaaag 400
 401 ttaacatggagcctttgcaaaatcatgtccttagtgagtccttagtgagtccttagtcatcgcaacgttttatttgtttataaaaag 480
 481 gttgataattatttgcaaaatcatgtccttagtgagtccttagtgagtccttagcgtcacacgtctagcatg 560
 561 attgagatattcaaagactccttctacaactcctttactctcgttatttatttattctatttctgttatttatg 640
 641 ccaaatatgtatctcgttatagctatcattgatagtagaaaataaaaaatctatataataataatcaatatttgcggtc 720
 721 ataatctaaattagttcgcttatattagctatcattgatagtagaaaaataaaataataataataataatttgcggtc 800
 801 gatactttgcaaaacattattgcctatatatattagctatcattgatagtagaaaaataaaataataataataatgttaaa 880
 881 actatttattaaaacgttatgatgacacttgcatatatagttgcataatgtcttaactgc                      958

959 ATG ACC GAA CAC CAT ACC CCC AAA AGC AGG ATT CTT CGC TTT CTA GAG AAT CAA TAT GTA  1018
   1  M   T   E   H   H   T   P   K   S   R   I   L   R   F   L   E   N   Q   Y   V    20

1019 TAC CTA TGT ACC TTA AAT GAT TAT GTA CAA CTT GTT TTG AGA GGG TCG CCG GCA AGC TCG  1078
  21  Y   L   C   T   L   N   D   Y   V   Q   L   V   L   R   G   S   P   A   S   S    40

1079 TAT AGC AAT ATA TGC GAA CGC TTG AGA AGC GAT GTA CAA ACG TCC TTT TCT ATT TTT CTT  1138
  41  Y   S   N   I   C   E   R   L   R   S   D   V   Q   T   S   F   S   I   F   L    60

1139 CAT TCG ACT GTA GTC GGC TTC GAC AGT AAG CCA GAT GAA GGT GTT CAA TTT TCT TCT CCA  1198
  61  H   S   T   V   V   G   F   D   S   K   P   D   E   G   V   Q   F   S   S   P    80

1199 AAA TGC TCA CAG TCA GAG gtatatatattttgatttttctattcgggatagctaaatatgggcag            1272
  81  K   C   S   Q   S   E                                                              86

1273 CTA ATA GCG AAT GTT GTA AAA CAG ATG TTC GAT GAA AGT TTT GAG CGT CGA AGG AAT CTA  1332
  87  L   I   A   N   V   V   K   Q   M   F   D   E   S   F   E   R   R   R   N   L   106

1333 CTG ATG AAA GGG TTT TCC ATG gtaaggtattctaattgtgaaatattacctgcaattactgtttcaaagaga   1405
 107  L   M   K   G   F   S   M                                                         113

1406 AAT CAT GAA GAT TTT CGA GCC ATG CAT GTA AAC GGA GTA CAA AAT                       1469
 114  N   H   E   D   F   R   A   M   H   V   N   G   V   Q   N                        128
```

FIG. 15A

```
1470 GAT CTC GTT TCT ACT TTT CCT AAT TAC CTT ATA TCT ATA CTT GAG TCA AAA AAT TGG CAA      1529
 129  D   L   V   S   T   F   P   N   Y   L   I   S   I   L   E   S   K   N   W   Q       148

1530 CTT TTG TTA GAA AT gtaaataccggttaagatgttgcgcactttgaacaagactgacaagtatag T ATC GGC      1601
 149  L   L   L   E   I                                                       I   G        155

1602 AGT GAT GCC ATG CAT TAC TTA TTA TCC AAA GGA AGT ATT TTT GAG GCT CTT CCA AAT GAC      1661
 156  S   D   A   M   H   Y   L   L   S   K   G   S   I   F   E   A   L   P   N   D       175

1662 AAT TAC CTT CAG ATT TCT GGC ATA CCA CTT TTT AAA AAT GTG TTT GAG GAA ACT GTG          1721
 176  N   Y   L   Q   I   S   G   I   P   L   F   K   N   V   F   E   E   T   V           195

1722 TCA AAA AAA AGA AAG CGA ACC ATT GAA ACA TCC ATT ACT CAA AAT AAA AGC GCC CGC AAA      1781
 196  S   K   K   R   K   R   T   I   E   T   S   I   T   Q   N   K   S   A   R   K       215

1782 GAA GTT TCC TGG AAT AGC ATT AGT AGG TTT TAC ATT TTT TAC AGG TCA TCC TAT              1841
 216  E   V   S   W   N   S   I   S   R   F   Y   I   F   Y   R   S   S   Y              235

1842 AAG AAG TTT AAG CAA G gtaactaatactgttatcctcataactaattttag AT CTA TAT TTT AAC          1907
 236  K   K   F   K   Q   D                                                  L   Y   F   N  245

1908 TTA CAC TCT ATT TGT GAT CGG AAC ACA GTA CAC ATG TGG CTT CAA TGG ATT TTT CCA AGG      1967
 246  L   H   S   I   C   D   R   N   T   V   H   M   W   L   Q   W   I   F   P   R       265

1968 CAA TTT GGA CTT ATA AAC GCA TTT CAA GTG AAG CAA TTG CAC AAA GTG ATT CCA CTG GTA      2027
 266  Q   F   G   L   I   N   A   F   Q   V   K   Q   L   H   K   V   I   P   L   V       285

2028 TCA CAG AGT ACA GTT GTG CCC CTA CGT CTC CTA AAG GTA TAC CTT ATT GAA CAA ACA          2087
 286  S   Q   S   T   V   V   P   L   R   L   L   K   V   Y   L   I   E   Q   T           305

2088 GCA AAG CGA CTC CAT GAT GAA AAA ATC CTT TCT CTA TCA AAA GTT TAC AAC CAT TAT ATT      2147
 306  A   K   R   L   H   D   E   K   I   L   S   L   S   K   V   Y   N   H   Y   I       325

2148 GAC ACC CAC GAT GAT AGT TAT TCC TTA AAG CCG AAC CAG GTG TTT GCG                      2207
 326  D   T   H   D   D   S   Y   S   L   K   P   N   Q   V   F   A                       345

2208 TTT CTT CGA TCC ATT CTT GTT CGA GTG TTT CCT AAA TTA ATC TGG GGT AAC CAA AGG ATA      2267
 346  F   L   R   S   I   L   V   R   V   F   P   K   L   I   W   G   N   Q   R   I       365
```

FIG. 15B

```
2268 TTT GAG ATA ATA TTA AAA G gtattgtataaaattattaccactaacgatttaccag AC CTC GAA ACT 2336
 366  F   E   I   I   L   K   D                                        L   E   T  375

2337 TTC TTG AAA TTA TCG AGA TAC GAG TCT TTT AGT TTA CAT TAT TTA ATG AGT AAC ATA AAG 2396
 376  F   L   K   L   S   R   Y   E   S   F   S   L   H   Y   L   M   S   N   I   K  395

2397 gtaatatgccaaattttttaccattaataacaatcag ATT TCA GAA ATT GAA TGG CTA GTC CTT GGA 2465
 396                                       I   S   E   I   E   W   L   V   L   G  405

2466 AAA AGG TCA AAT GCG AAA ATG TGC TTA AGT GAT TTT GAG AAA CGC AAG CAA ATA TTT GCG 2525
 406  K   R   S   N   A   K   M   C   L   S   D   F   E   K   R   K   Q   I   F   A  425

2526 GAA TTC ATC TAC TGG CTA TAC AAT TCG TTT ATA ATA CCT ATT TTA CAA TCT TTT TTT TAT 2585
 426  E   F   I   Y   W   L   Y   N   S   F   I   I   P   I   L   Q   S   F   F   Y  445

2586 ATC ACT GAA TCA GAT GAT TTA CGA AAT CGA ACT GTT TAT TTT AGA AAA ATG GAA GAT ATT 2645
 446  I   T   E   S   D   D   L   R   N   R   T   V   Y   F   R   K   M   E   D   I  465

2646 CTC TTG TGC CGA CCC TTT ATT ACA TCA ATG AAA ATG GAA GCG TTT GAA AAA ATA AAC GAG 2705
 466  L   L   C   R   P   F   I   T   S   M   K   M   E   A   F   E   K   I   N   E  485

2706 gtatttaaagtattttttgcaaaaagctaaatatttcag AAC AAT GTT AGG ATG GAT ACT CAG AAA ACT 2775
 486                                         N   N   V   R   M   D   T   Q   K   T  495

2776 ACT TTG CCT CCA GCA GTT ATT CGT CTA TTA CCT AAG AAG AAT ACC TTT CGT CTC ATT ACG 2835
 496  T   L   P   P   A   V   I   R   L   L   P   K   K   N   T   F   R   L   I   T  515

2836 AAT TTA AGA AAA AGA TTC TTA ATA AAA ATG TTA GTC AGT ACG AGT GAA AGT gtattaatttttggtcatcaatgtacttacttctaatctatta 2906
 516  N   L   R   K   R   F   L   I   K   M   L   V   S   T   S   E   S                                                 524

2907 ttagcag ATG GGT TCA AAC CAT TTA ATC AAT GAA AAG GAT CTT CTT ACT TTA CGA CCT GTG 2967
 525         M   G   S   N   H   L   I   N   E   K   D   L   L   T   L   R   P   V  542

2968 GCA TCG ATA CTG AAA CAT TTA ATC AAT GAA AGT AGT ATT GGT ATT CCA TTT AAC TTG GAG 3027
 543  A   S   I   L   K   H   L   I   N   E   S   S   I   G   I   P   F   N   L   E  562

3028 GTT TAC ATG AAG CTT CTT ACT TTT AAG AAG GAT CTT CTT AAG CAC CGA ATG TTT GG gtaat 3088
 563  V   Y   M   K   L   L   T   F   K   K   D   L   L   K   H   R   M   F   G       581
```

*FIG. 15C*

```
3089 tataataatgcgcgattcctcattattttgcag G CGT AAG AAG TAT TTT GTA CGG ATA GAT ATA  3155
 582                                    R   K   K   Y   F   V   R   I   D   I    591

3156 AAA TCC TGT TAT GAT CGA ATA AAG CAA GAT TTG ATG TTT CGG ATT GTT AAA AAG CTC  3215
 592  K   S   C   Y   D   R   I   K   Q   D   L   M   F   R   I   V   K   K   L   611

3216 AAG GAT CCC GAA TTT GTA ATT CGA AAG TAT GCA ACC ATA CAT GCA ACA AGT GAC GCT  3275
 612  K   D   P   E   F   V   I   R   K   Y   A   T   I   H   A   T   S   D   A   631

3276 ACA AAA AAC TTT GTT AGT GAG GCG TTT TCC TAT T gtaagtttattttcattggaattttaacaa 3343
 632  T   K   N   F   V   S   E   A   F   S   Y   F                                643

3344 attcttttag TT GAT ATG GTG CAG CCT TTT GAA AAA GTC GTG CAG TTA CTT TCT ATG AAA ACA 3405
 644            D   M   V   Q   P   F   E   K   V   V   Q   L   L   S   M   K   T   659

3406 TCA GAT ACT TTG TTT GAT TTT GTG GAT TAT TGG ACC AAA AGT TCT TCT GAA ATT TTT  3465
 660  S   D   T   L   F   D   F   V   D   Y   W   T   K   S   S   S   E   I   F    679

3466 AAA ATG CTC AAG GAA CAT CTC TCT GGA CAC ATT GTT AAG gtataccaattgttgaattgtaataaca 3532
 680  K   M   L   K   E   H   L   S   G   H   I   V   K                             692

3533 ctaatgaaactag ATA GGA AAT TCT CAA TAC CTT CAA AAA GTT GGT ATC CCT CAG GGC TCA 3593
 693                I   G   N   S   Q   Y   L   Q   K   V   G   I   P   Q   G   S   708

3594 ATT CTG TCA TCT TTT TTG TGT CAT TTC TAT ATG GAA GAT TTG ATT GAT GAA TAC CTA TCG 3653
 709  I   L   S   S   F   L   C   H   F   Y   M   E   D   L   I   D   E   Y   L   S   728

3654 TTT ACG AAA AAG AAA GGA TCA GTG TTG TTA CGA GTA GTC GAC GAT TTC CTC TTT ATA ACA 3713
 729  F   T   K   K   K   G   S   V   L   L   R   V   V   D   D   F   L   F   I   T   748

3714 GTT AAT AAA AAG GAT GCA AAA AAA TTT TTG AAT TTA TCT TTA AGA G gtgagttgctgtcattcc 3777
 749  V   N   K   K   D   A   K   K   F   L   N   L   S   L   R   G                  764

3778 taagttctaaccgttgaag GA TTT GAG AAA AAT GGG ATA ATA AAC CAC AAT TTT TCT ACG AGC CTG GAG AAA ACA GTA 3840
 765                      F   E   K   N   G   I   I   N   H   N   F   S   T   S   L   E   K   T   V    778

3841 ATA AAC TTT GAA AAT AGT AAT AAC ATT GAA ATA ATA AAC AAT ACT TTT TTT AAT GAA AGC AAG AAA 3900
 779  I   N   F   E   N   S   N   N   I   E   I   I   N   N   T   F   F   N   E   S   K   K    798
```

*FIG. 15D*

```
3901 AGA ATG CCA TTC TTC GGT TTC TCT GTG AAC ATG AGG TCT CTT GAT ACA TTG TTA GCA TGT 3960
799  R   M   P   F   F   G   F   S   V   N   M   R   S   L   D   T   L   L   A   C   818

3961 CCT AAA ATT GAT GAA GCC TTA TTT AAC TCT ACA GAG CTG ACG AAA CAT ATG GGG         4020
819  P   K   I   D   E   A   L   F   N   S   T   V   E   L   T   K   H   M   G     838

4021 AAA TCT TTT TTT TAC AAA ATT CTA AG gtatactgtgtaactgaatagctgacaaataatcag A TCG   4089
839  K   S   F   F   Y   K   I   L   R                                       S     848

4090 AGC CTT GCA TCC TTT GCA CAA GTA TTT ATT GAC ATT ACC CAC AAT TCA AAA TTC AAT TCT 4149
849  S   L   A   S   F   A   Q   V   F   I   D   I   T   H   N   S   K   F   N   S   868

4150 TGC TGC AAT ATA TAT AGG CTA GGA TAC TCT ATG TGT ATG AGA GCA CAA GCA TAC TTA AAA 4209
869  C   C   N   I   Y   R   L   G   Y   S   M   C   M   R   A   Q   A   Y   L   K   888

4210 AGG ATG AAG GAT ATA TTT ATT CCC CAA AGA ATG TTC ATA ACG G gtgagtacttatttaactaga 4274
889  R   M   K   D   I   F   I   P   Q   R   M   F   I   T   D                       903

4275 aaagtcattaattaaccttag AT CTT TTG AAT GTT ATT GGA AGA AAA ATT TGG AAA AAG TTG GCC 4339
904                          L   L   N   V   I   G   R   K   I   W   K   K   L   A   917

4340 GAA ATA TTA GGA TAT ACG AGT CGT AGG CGT TTC TTG TCC TCT GCA GAA GTC AAA TG gtacgtgtc 4401
918  E   I   L   G   Y   T   S   R   R   R   F   L   S   S   A   E   V   K   W           935

4402 ggtctcgagacttcagcaatattgacacatcag G CTT TTT TGT CTT GGA ATG AGA GAT GGT TTG AAA 4468
936                                     L   F   C   L   G   M   R   D   G   L   K   946

4469 CCC TCT TTC AAA TAT CAT CCA TGC TTC GAA CAG CTA ATA TAC CAA TTT CAG TCA TTG ACT 4528
947  P   S   F   K   Y   H   P   C   F   E   Q   L   I   Y   Q   F   Q   S   L   T   966

4529 GAT CTT ATC AAG CCG CTA AGA CCA GTT TTG CGA CAG GTG TTA TTT TTA CAT AGA AGA ATA 4588
967  D   L   I   K   P   L   R   P   V   L   R   Q   V   L   F   L   H   R   R   I   986

4589 GCT GAT TAA tgtcatttcaattattatatacatcccttattactggtgtcttaaacatattattactaagtata   4665
987  A   D   *                                                                        989
```

FIG. 15E

```
4666  gctgaccccaaagcaagcatactataggatttctagtaaagtaaaattaatctcgttattagttttgattgacttgtct  4745
4746  ttatccttatactttaagaaagattgacagtggttgctgactactgcccacatgccattaaacgggagtggttaaaca  4825
4826  ttaaagtaatacatgaggctaatctcctttcatttagaataaggaaagtggtttctataatgaataatgcccgcacta  4905
4906  atgcaaaaagacgaagattatcttctaaacaagggggattaagcatatccgaaggaaaagagagtaatataccagtgtt  4985
4986  gttgaagaagcaaggataatttggccggcttctgcagatgacaaggctaaattttggtgaccgaattttggtaaaagc  5065
5066  cccaggttatccatggtgcgcggcttgcctactgagacgaaaagaaactaaggatagtttgaatactaatagctcatta  5145
5146  atgtcttatataaggttttgttttttcctgacttcaaatttgcatgggtgaaaagaaactattgaagcttaagccattattggat  5225
5226  tccgaatagccaaattctcttggttcctccaccgatgaggaaatcggaaagtctaaagaacggaaagtctatcagctgctgaggagaagcttatgaggctgctgaggagaagcctaattttttgc  5305
5306  tcctgatttaaaggaggaatatcattgggagacatctcttgatgaatcagatgcggagagtatctccagcagtacgcggagagaagttgattatctccagcagtacgcggagagtatctccagcagtacgcggagagtatctccagcagtacgcggagagtatctccagcagtacgcggatcttccagcagtacgcggatcttccagtacgcggagagtatctccagcagtacgcggatcctgatgtcaata  5385
5386  aaaaagaaaaatatcattgggagacatctcttgatgaatcagatgcggagagtatctccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcggatcttccagcagtacgcaata  5465
5466  acttctatttctgaaatgtatggtcctactgtcgcttcgactctgtgtagctcgtagctagctctctacgcagtcagttgaccaaaggtacc  5544
```

FIG. 15F

```
   1 gcagcgctgc gtcctgctgc gcacgtggga agccctggcc ccggccaccc ccgcgatgcc
  61 gcgcgctccc cgctgccgag ccgtgcgctc cctgctgcgc agccactacc gcgaggtgct
 121 gccgctggcc acgttcgtgc ggcgcctggc gccccagggc tggcggctgg tgcagcgcgg
 181 ggacccggcg gctttccgcg cgctggtggc ccagtgcctg gtgtgcgtgc cctgggacgc
 241 acggccgccc ccgccgccc cctccttccg ccaggtgtcc tgcctgaagg agctggtggc
 301 ccgagtgctg cagaggctgt gcgagcgcgg cgcgaagaac gtgctggcct tcggcttcgc
 361 gctgctggac ggggcccgcg ggggccccc cgaggccttc accaccagcg tgcgcagcta
 421 cctgcccaac acggtgaccg acgcactgcg ggggagcggg gcgtggggc tgctgctgcg
 481 ccgcgtgggc gacgacgtgc tggttcacct gctggcacgc tgcgcgctct ttgtgctggt
 541 ggctcccagc tgcgcctacc aggtgtgcgg gccgccgctg taccagctcg gcgctgccac
 601 tcaggcccgg ccccccgccac acgctagtgga accccgaagg cgtctgggat gcgaacgggc
 661 ctggaaccat agcgtcaggg aggccggggt cccctgggc ctgccagccc cgggtgcgag
 721 gaggcgcggg ggcagtgcca gccgaagtct gccgttgccc aagaggccca ggcgtggcgc
 781 tgcccctgag ccggagcgga cgcccgttgg gcaggggtcc tgggcccacc cgggcaggac
 841 gcgtggaccg agtgaccgtg gtttctgtgt ggtgtcacct gccagacccg ccgaagaagc
 901 cacctctttg gagggtgcgc tctctggcac gcgccactcc cacccatccg tgggccgcca
 961 gcaccacgcg ggccccccat ccacatcgcg gccaccacgt ccctgggaca cgccttgtcc
1021 cccggtgtac gccgagacca agcacttcct ctactcctca ggcgacaagg agcagctgcg
1081 gccctccttc ctactcagct ctctggagcc cagcctgact ggcgctcgga ggctcgttgga
1141 gaccatcttt ctgggttcca ggccctggat gccaggact ccccgcaggt tgccccgcct
1201 gccccagcgc tactggcaaa tgcggcccct gtttctggag ctgcttggga accacgcgca
1261 gtgcccctac ggggtgctcc tcaagacgca ctgccgctg cgagctgcgg tcaccccagc
1321 agccggtgtc tgtgcccggg agaagcccca gggctctgtg gcggcccccg aggaggagga
1381 cacagacccc cgtcgcctgg tgcagctgct ccgccagcac agcagcccct ggcaggtgta
1441 cggcttcgtg cgggcctgcc tgcgccggct ggtgcccccca ggcctctggg ctccaggca
1501 caacgaacgc cgcttcctca ggaacaccaa gaagttcatc tccctgggga agcatgccaa
1561 gctctcgctg caggagctga cgtggaagat gagcgtgcgg gactgcgctt ggctgcgcag
1621 gagcccaggg gttggctgtg ttccggccgc agagcaccgt ctgcgtgagg agatcctggc
1681 caagttcctg cactggctga tgagtgtgta cgtcgtcgag ctgctcaggt cttctttta
1741 tgtcacggag accacgtttc aaaagaacag gctctttttc taccggaaga gtgtctggag
1801 caagttgcaa agcattggaa tcagacagca cttgaagagg gtgcagctgc gggagctgtc
1861 ggaagcagag gtcaggcagc atcgggaagc caggcccgcc ctgctgacgt ccagactccg
1921 cttcatcccc aagcctgacg ggctgcggcc gattgtgaac atggactacg tcgtgggagc
1981 cagaacgttc cgcagagaaa agagggccga gcgtctcacc tcgagggtga aggcactgtt
2041 cagcgtgctc aactacgagc gggcgccgcc ccccgccctc ctgggcgcct ctgtgctggg
2101 cctggacgat atccacaggg cctgcgcac cttcgtgctg cgtgtgcggg cccaggaccc
2161 gccgcctgag ctgtactttg tcaaggtgga tgtgacgggc gcgtacgaca ccatccccca
2221 ggacaggctc acggaggtca tcgccagcat catcaaaccc cagaacacgt actgcgtgcg
2281 tcggtatgcc gtggtccaga aggccgccca tgggcacgtc cgcaaggcct tcaagagcca
2341 cgtctctacc ttgacagacc tccagccgta catgcgacag ttcgtggctc acctgcagga
2401 gaccagcccg ctgagggatg ccgtcgtcat cgagcagagc tcctccctga atgaggccag
2461 cagtggcctc ttccagtct tcctacgctc catgtgccac cacgccgtgc gcatcagggg
2521 caagtcctac gtccagtgcc aggggatccc gcagggctcc atcctctcca cgctgctctg
2581 cagcctgtgc tacggcgaca tggagaacaa gctgtttgcg gggattcggc gggacgggct
2641 gctcctgcgt ttggtggatg atttcttgtt ggtgacacct cacctcaccc acgcgaaaac
2701 cttcctcagg accctggtcc gaggtgtccc tgagtatggc tgcgtggtga acttgcggaa
2761 gacagtggtg aacttccctg tagaagacga ggccctgggt ggcacggctt ttgttcagat
2821 gccggccac ggcctattcc cctggtgcgg cctgctgctg gatacccgga ccctggaggt
2881 gcagagcgac tactccagct atgcccggac ctccatcaga gccagtctca ccttcaaccg
2941 cggcttcaag gctgaggagg acatgcgtgc caaactcttt ggggtcttcg ggctgaagtg
3001 tcacagcctg tttctggatt tgcaggtgaa cagcctccag acggtgtgca ccaacatcta
3061 caagatcctc ctgctgcagg cgtacaggtt tcacgcatgt gtgctgcagc tcccatttca
3121 tcagcaagtt tggaagaacc ccacatttt cctgcgcgtc atctctgaca cggcctccct
3181 ctgctactcc atcctgaaag ccaagaacgc agggatgtcg ctggggcca agggcgccgc
3241 cggccctctg ccctccgagg ccgtgcagtg gctgtgccac aagcattcc tgctcaagct
3301 gactcgacac cgtgtcacct acgtgccact cctggggtca ctcaggacag cccagacgca
3361 gctgagtcgg aagctcccgg gacgacgct gactgccctg gaggccgcag ccaacccggc
3421 actgccctca gacttcaaga ccatcctgga ctgatggcca cccgcccaca gccaggccga
3481 gagcagacac cagcagccc gtcacgccgg gctctacgtc ccaggagggg aggggcggcc
3541 cacacccagg cccgcaccgc tgggagtctg aggcctgagt gagtgtttgg ccgaggcctg
3601 catgtccggc tgaaggctga gtgtccggct gaggcctgag cgagtgtcca gccaagggct
3661 gagtgtccag cacacctgcc gtcttcactt cccacaggc tggcgctcgg ctccacccca
3721 gggccagctt ttcctcacca ggagcccggc ttccactccc acataggaa tagtccatcc
3781 ccagattcgc cattgttcac ccctcgccct gccctccttt gccttccacc ccaccatcc
3841 aggtggagac cctgagaagg accctgggag ctctgggaat ttggagtgac caaaggtgtg
3901 ccctgtacac aggcgaggac cctgcacctg gatggggtc cctgtgggtc aaattggggg
3961 gaggtgctgt gggagtaaaa tactgaatat atgagttttt cagttttgaa aaaaa
```

FIG. 16

MPRAPRCRAVRSLLRSHYREVLPLATFVRRLGPQGWRLVQRGDP
AAFRALVAQCLVCVPWDARPPPAAPSFRQVSCLKELVARVLQRL
CERGAKNVLAFGFALLDGARGGPPEAFTTSVRSYLPNTVTDALR
GSGAWGLLLRRVGDDVLVHLLARCALFVLVAPSCAYQVCGPPLY
QLGAATQARPPPHASGPRRRLGCERAWNHSVREAGVPLGLPAPG
ARRRGGSASRSLPLPKRPRRGAAPEPERTPVGQGSWAHPGRTRG
PSDRGFCVVSPARPAEEATSLEGALSGTRHSHPSVGRQHHAGPP
STSRPPRPWDTPCPPVYAETKHFLYSSGDKEQLRPSFLLSSLRP
SLTGARRLVETIFLGSRPWMPGTPRRLPRLPQRYWQMRPLFLEL
LGNHAQCPYGVLLKTHCPLRAAVTPAAGVCAREKPQGSVAAPEE
EDTDPRRLVQLLRQHSSPWQVYGFVRACLRRLVPPGLWGSRHNE
RRFLRNTKKFISLGKHAKLSLQELTWKMSVRDCAWLRRSPGVGC
VPAAEHRLREEILAKFLHWLMSVYVVELLRSFFYVTETTFQKNR
LFFYRKSVWSKLQSIGIRQHLKRVQLRELSEAEVRQHREARPAL
LTSRLRFIPKPDGLRPIVNMDYVVGARTFRREKRAERLTSRVKA
LFSVLNYERARRPGLLGASVLGLDDIHRAWRTFVLRVRAQDPPP
ELYFVKVDVTGAYDTIPQDRLTEVIASIIKPQNTYCVRRYAVVQ
KAAHGHVRKAFKSHVSTLTDLQPYMRQFVAHLQETSPLRDAVVI
EQSSSLNEASSGLFDVFLRFMCHHAVRIRGKSYVQCQGIPQGSI
LSTLLCSLCYGDMENKLFAGIRRDGLLLRLVDDFLLVTPHLTHA
KTFLRTLVRGVPEYGCVVNLRKTVVNFPVEDEALGGTAFVQMPA
HGLFPWCGLLLDTRTLEVQSDYSSYARTSIRASLTFNRGFKAGR
NMRRKLFGVLRLKCHSLFLDLQVNSLQTVCTNIYKILLLQAYRF
HACVLQLPFHQQVWKNPTFFLRVISDTASLCYSILKAKNAGMSL
GAKGAAGPLPSEAVQWLCHQAFLLKLTRHRVTYVPLLGSLRTAQ
TQLSRKLPGTTLTALEAAANPALPSDFKTILD

FIG. 17

GGCCAAGTTCCTGCACTGGCTGATGAGTGTGTACGTCGTCGAGCTGCTCAGGTCTTTCTT
TTATGTCACGGAGACCACGTTTCAAAAGAACAGGCTCTTTTTCTACCGGAAGAGTGTCTG
GAGCAAGTTGCAAAGCATTGGAATCAGACAGCACTTGAAGAGGGTGCAGCTGCGGGAGCT
GTCGGAAGCAGAGGTCAGGCAGCATCGGGAAGCCAGGCCCGCCCTGCTGACGTCCAGACT
CCGCTTCATCCCCAAGCCTGACGGCCTGCGGCCGATTGTGAACATGGACTACGTCGTGGG
AGCCAGAACGTTCCGCAGAGAAAAGAGGGCCGAGCGTCTCACCTCGAGGGTGAAGGCACT
GTTCAGCGTGCTCAACTACGAGCGGGCGCGGCGCCCCGGCCTCCTGGGCGCCTCTGTGCT
GGGCCTGGACGATATCCACAGGGCCTGGCGCACCTTCGTGCTGCGTGTGCGGGCCCAGGA
CCCGCCGCCTGAGCTGTACTTTGTCAAGGTGGATGTGACGGGCGCGTACGACACCATCCC
CCAGGACAGGCTCACGGAGGTCATCGCCAGCATCATCAAACCCCAGAACACGTACTGCGT
GCGTCGGTATGCCGTGGTCCAGAAGGCCGCCCATGGGCACGTCCGCAAGGCCTTCAAGAG
CCACGTCCTACGTCCAGTGCCAGGGGATCCCGCAGGGCTCCATCCTCTCCACGCTGCTCT
GCAGCCTGTGCTACGGCGACATGGAGAACAAGCTGTTTGCGGGGATTCGGCGGGACGGGC
TGCTCCTGCGTTTGGTGGATGATTTCTTGTTGGTGACACCTCACCTCACCCACGCGAAAA
CCTTCCTGAGGACCCTGGTCCGAGGTGTCCCTGAGTATGGCTGCGTGGTGAACTTGCGGA
AGACAGTGGTGAACTTCCCTGTAGAAGACGAGGCCCTGGGTGGCACGGCTTTTGTTCAGA
TGCCGGCCCACGGCCTATTCCCCTGGTGCGGCCTGCTGCTGGATACCCGGACCCTGGAGG
TGCAGAGCGACTACTCCAGCTATGCCCGGACCTCCATCAGAGCCAGTCTCACCTTCAACC
GCGGCTTCAAGGCTGGGAGGAACATGCGTCGCAAACTCTTTGGGGTCTTGCGGCTGAAGT
GTCACAGCCTGTTTCTGGATTTGCAGGTGAACAGCCTCCAGACGGTGTGCACCAACATCT
ACAAGATCCTCCTGCTGCAGGCGTACAGGTTTCACGCATGTGTGCTGCAGCTCCCATTTC
ATCAGCAAGTTTGGAAGAACCCCACATTTTTCCTGCGCGTCATCTCTGACACGGCCTCCC
TCTGCTACTCCATCCTGAAAGCCAAGAACGCAGGGATGTCGCTGGGGGCCAAGGGCGCCG
CCGGCC7TCTGCCCTCCGAGGCCGTGCAGTGGCTGTGCCACCAAGCATTCCTGCTCAAGC
TGACTCGACACCGTGTCACCTACGTGCCACTCCTGGGGTCACTCAGGACAGCCCAGACGC
AGCTGAGTCGGAAGCTCCCGGGGACGACGCTGACTGCCCTGGAGGCCGCAGCCAACCCGG
CACTGCCCTCAGACTTCAAGACCATCCTGGACTGATGGCCACCCGCCCACAGCCAGGCCG
AGAGCAGACACCAGCAGCCCTGTCACGCCGGGCTCTACGTCCCAGGGAGGGAGGGCGGC
CCACACCCAGGCCTGCACCGCTGGGAGTCTGAGGCCTGAGTGAGTGTTTGGCCGAGGCCT
GCATGTCCGGCTGAAGGCTGAGTGTCCGGCTGAGGCCTGAGCGAGTGTCCAGCCAAGGGC
TGAGTGTCCAGCACACCTGCCGTCTTCACTTCCCCACAGGCTGGCGCTCGGCTCCACCCC
AGGGCCAGCTTTTCCTCACCAGGAGCCCGGCTTCCACTCCCCACATAGGAATAGTCCATC
CCCAGATTCGCCATTGTTCACCCCTCGCCCTGCCCTCCTTTGCCTTCCACCCCCACCATC
CAGGTGGAGACCCTGAGAAGGACCCTGGGAGCTCTGGGAATTTGGAGTGACCAAAGGTGT
GCCCTGTACACAGGCGAGGACCCTGCACCTGGATGGGGGTCCCTGTGGGTCAAATTGGGG
GGAGGTGCTGTGGGAGTAAAATACTGAATATATGAGTTTTTCAGTTTTG0AAAAAAAAAA
AAAAAAAAAAAAAAAA

FIG. 18

MetSerValTyrValValGluLeuLeuArgSerPhePhe
TyrValThrGluThrThrPheGlnLysAsnArgLeuPhe
PheTyrArgLysSerValTrpSerLysLeuGlnSerIle
GlyIleArgGlnHisLeuLysArgValGlnLeuArgGlu
LeuSerGluAlaGluValArgGlnHisArgGluAlaArg
ProAlaLeuLeuThrSerArgLeuArgPheIleProLys
ProAspGlyLeuArgProIleValAsnMetAspTyrVal
ValGlyAlaArgThrPheArgArgGluLysArgAlaGlu
ArgLeuThrSerArgValLysAlaLeuPheSerValLeu
AsnTyrGluArgAlaArgArgProGlyLeuLeuGlyAla
SerValLeuGlyLeuAspAspIleHisArgAlaTrpArg
ThrPheValLeuArgValArgAlaGlnAspProProPro
GluLeuTyrPheValLysValAspValThrGlyAlaTyr
AspThrIleProGlnAspArgLeuThrGluValIleAla
SerIleIleLysProGlnAsnThrTyrCysValArgArg
TyrAlaValValGlnLysAlaAlaHisGlyHisValArg
LysAlaPheLysSerHisValLeuArgProValProGly
AspProAlaGlyLeuHisProLeuHisAlaAlaLeuGln
ProValLeuArgArgHisGlyGluGlnAlaValCysGly
AspSerAlaGlyArgAlaAlaProAlaPheGlyGly

FIG. 19

```
                                                              1
                                                              met
GCAGCGCTGCGTCCTGCTGCGCACGTGGGAAGCCCTGGCCCCGGCCACCCCCGCG ATG 10
pro arg ala pro arg cys arg ala val arg ser leu leu arg ser
CCG CGC GCT CCC CGC TGC CGA GCC GTG CGC TCC CTG CTG CGC AGC 20                                          30
his tyr arg glu val leu pro leu ala thr phe val arg arg leu
CAC TAC CGC GAG GTG CTG CCG CTG GCC ACG TTC GTG CGG CGC CTG 40
gly pro gln gly trp arg leu val gln arg gly asp pro ala ala
GGG CCC CAG GGC TGG CGG CTG GTG CAG CGC GGG GAC CCG GCG GCT 50                                          60
phe arg ala leu val ala gln cys leu val cys val pro trp asp
TTC CGC GCG CTG GTG GCC CAG TGC CTG GTG TGC GTG CCC TGG GAC ala arg pro pro pro ala ala pro ser phe arg gln val ser cys
GCA CGG CCG CCC CCC GCC GCC CCC TCC TTC CGC CAG GTG TCC TGC 80                                          90
leu lys glu leu val ala arg val leu gln arg leu cys glu arg
CTG AAG GAG CTG GTG GCC CGA GTG CTG CAG AGG CTG TGC GAG CGC 100
gly ala lys asn val leu ala phe gly phe ala leu leu asp gly
GGC GCG AAG AAC GTG CTG GCC TTC GGC TTC GCG CTG CTG GAC GGG 110                                         120
ala arg gly gly pro pro glu ala phe thr thr ser val arg ser
GCC CGC GGG GGC CCC CCC GAG GCC TTC ACC ACC AGC GTG CGC AGC
```

FIG. 20A

```
                                    130
tyr leu pro asn thr val thr asp ala leu arg gly ser gly ala
TAC CTG CCC AAC ACG GTG ACC GAC GCA CTG CGG GGG AGC GGG GCG 140                                 150
trp gly leu leu leu arg arg val gly asp asp val leu val his
TGG GGG CTG CTG CTG CGC CGC GTG GGC GAC GAC GTG CTG GTT CAC 160
leu leu ala arg cys ala leu phe val leu val ala pro ser cys
CTG CTG GCA CGC TGC GCG CTC TTT GTG CTG GTG GCT CCC AGC TGC 170                         180
ala tyr gln val cys gly pro pro leu tyr gln leu gly ala ala
GCC TAC CAG GTG TGC GGG CCG CCG CTG TAC CAG CTC GGC GCT GCC 190
thr gln ala arg pro pro pro his ala ser gly pro arg arg arg
ACT CAG GCC CGG CCC CCG CCA CAC GCT AGT GGA CCC CGA AGG CGT 200                             210
leu gly cys glu arg ala trp asn his ser val arg glu ala gly
CTG GGA TGC GAA CGG GCC TGG AAC CAT AGC GTC AGG GAG GCC GGG 220
val pro leu gly leu pro ala pro gly ala arg arg arg gly gly
GTC CCC CTG GGC CTG CCA GCC CCG GGT GCG AGG AGG CGC GGG GGC 230                             240
ser ala ser arg ser leu pro leu pro lys arg pro arg arg gly
AGT GCC AGC CGA AGT CTG CCG TTG CCC AAG AGG CCC AGG CGT GGC 250
ala ala pro glu pro glu arg thr pro val gly gln gly ser trp
GCT GCC CCT GAG CCG GAG CGG ACG CCC GTT GGG CAG GGG TCC TGG 260                             270
ala his pro gly arg thr arg gly pro ser asp arg gly phe cys
GCC CAC CCG GGC AGG ACG CGT GGA CCG AGT GAC CGT GGT TTC TGT 280
val val ser pro ala arg pro ala glu glu ala thr ser leu glu
GTG GTG TCA CCT GCC AGA CCC GCC GAA GAA GCC ACC TCT TTG GAG 290                                 300
gly ala leu ser gly thr arg his ser his pro ser val gly arg
GGT GCG CTC TCT GGC ACG CGC CAC TCC CAC CCA TCC GTG GGC CGC 310
gln his his ala gly pro pro ser thr ser arg pro pro arg pro
CAG CAC CAC GCG GGC CCC CCA TCC ACA TCG CGG CCA CCA CGT CCC 320                             330
trp asp thr pro cys pro pro val tyr ala glu thr lys his phe
TGG GAC ACG CCT TGT CCC CCG GTG TAC GCC GAG ACC AAG CAC TTC
```

FIG. 20B

```
                                    340
leu tyr ser ser gly asp lys glu gln leu arg pro ser phe leu
CTC TAC TCC TCA GGC GAC AAG GAG CAG CTG CGG CCC TCC TTC CTA 350                                     360
leu ser ser leu arg pro ser leu thr gly ala arg arg leu val
CTC AGC TCT CTG AGG CCC AGC CTG ACT GGC GCT CGG AGG CTC GTG 370
glu thr ile phe leu gly ser arg pro trp met pro gly thr pro
GAG ACC ATC TTT CTG GGT TCC AGG CCC TGG ATG CCA GGG ACT CCC 380                                     390
arg arg leu pro arg leu pro gln arg tyr trp gln met arg pro
CGC AGG TTG CCC CGC CTG CCC CAG CGC TAC TGG CAA ATG CGG CCC 400
leu phe leu glu leu leu gly asn his ala gln cys pro tyr gly
CTG TTT CTG GAG CTG CTT GGG AAC CAC GCG CAG TGC CCC TAC GGG 410                                     420
val leu leu lys thr his cys pro leu arg ala ala val thr pro
GTG CTC CTC AAG ACG CAC TGC CCG CTG CGA GCT GCG GTC ACC CCA 430
ala ala gly val cys ala arg glu lys pro gln gly ser val ala
GCA GCC GGT GTC TGT GCC CGG GAG AAG CCC CAG GGC TCT GTG GCG 440                                     450
ala pro glu glu glu asp thr asp pro arg arg leu val gln leu
GCC CCC GAG GAG GAG GAC ACA GAC CCC CGT CGC CTG GTG CAG CTG 460
leu arg gln his ser ser pro trp gln val tyr gly phe val arg
CTC CGC CAG CAC AGC AGC CCC TGG CAG GTG TAC GGC TTC GTG CGG 470                                     480
ala cys leu arg arg leu val pro pro gly leu trp gly ser arg
GCC TGC CTG CGC CGG CTG GTG CCC CCA GGC CTC TGG GGC TCC AGG 490
his asn glu arg arg phe leu arg asn thr lys lys phe ile ser
CAC AAC GAA CGC CGC TTC CTC AGG AAC ACC AAG AAG TTC ATC TCC 500                                     510
leu gly lys his ala lys leu ser leu gln glu leu thr trp lys
CTG GGG AAG CAT GCC AAG CTC TCG CTG CAG GAG CTG ACG TGG AAG 520
met ser val arg asp cys ala trp leu arg arg ser pro gly val
ATG AGC GTG CGG GAC TGC GCT TGG CTG CGC AGG AGC CCA GGG GTT 530                                     540
gly cys val pro ala ala glu his arg leu arg glu glu ile leu
GGC TGT GTT CCG GCC GCA GAG CAC CGT CTG CGT GAG GAG ATC CTG
```

FIG. 20C

```
                                          550
ala lys phe leu his trp leu met ser val tyr val val glu leu
GCC AAG TTC CTG CAC TGG CTG ATG AGT GTG TAC GTC GTC GAG CTG 560                                          570
leu arg ser phe phe tyr val thr glu thr thr phe gln lys asn
CTC AGG TCT TTC TTT TAT GTC ACG GAG ACC ACG TTT CAA AAG AAC 580
arg leu phe phe tyr arg lys ser val trp ser lys leu gln ser
AGG CTC TTT TTC TAC CGG AAG AGT GTC TGG AGC AAG TTG CAA AGC
                  590                                  600
ile gly ile arg gln his leu lys arg val gln leu arg glu leu
ATT GGA ATC AGA CAG CAC TTG AAG AGG GTG CAG CTG CGG GAG CTG 610
ser glu ala glu val arg gln his arg glu ala arg pro ala leu
TCG GAA GCA GAG GTC AGG CAG CAT CGG GAA GCC AGG CCC GCC CTG 620                                          630
leu thr ser arg leu arg phe ile pro lys pro asp gly leu arg
CTG ACG TCC AGA CTC CGC TTC ATC CCC AAG CCT GAC GGG CTG CGG 640
pro ile val asn met asp tyr val val gly ala arg thr phe arg
CCG ATT GTG AAC ATG GAC TAC GTC GTG GGA GCC AGA ACG TTC CGC 650                                          660
arg glu lys arg ala glu arg leu thr ser arg val lys ala leu
AGA GAA AAG AGG GCC GAG CGT CTC ACC TCG AGG GTG AAG GCA CTG 670
phe ser val leu asn tyr glu arg ala arg arg pro gly leu leu
TTC AGC GTG CTC AAC TAC GAG CGG GCG CGG CGC CCC GGC CTC CTG 680                                          690
gly ala ser val leu gly leu asp asp ile his arg ala trp arg
GGC GCC TCT GTG CTG GGC CTG GAC GAT ATC CAC AGG GCC TGG CGC 700
thr phe val leu arg val arg ala gln asp pro pro pro glu leu
ACC TTC GTG CTG CGT GTG CGG GCC CAG GAC CCG CCG CCT GAG CTG 710                                          720
tyr phe val lys val asp val thr gly ala tyr asp thr ile pro
TAC TTT GTC AAG GTG GAT GTG ACG GGC GCG TAC GAC ACC ATC CCC 730
gln asp arg leu thr glu val ile ala ser ile ile lys pro gln
CAG GAC AGG CTC ACG GAG GTC ATC GCC AGC ATC ATC AAA CCC CAG 740                                          750
asn thr tyr cys val arg arg tyr ala val val gln lys ala ala
AAC ACG TAC TGC GTG CGT CGG TAT GCC GTG GTC CAG AAG GCC GCC
```

*FIG. 20D*

```
                          760
his gly his val arg lys ala phe lys ser his val leu arg pro
CAT GGG CAC GTC CGC AAG GCC TTC AAG AGC CAC GTC CTA CGT CCA
              770                              780
val pro gly asp pro ala gly leu his pro leu his ala ala leu
GTG CCA GGG GAT CCC GCA GGG CTC CAT CCT CTC CAC GCT GCT CTG
                              790
gln pro val leu arg arg his gly glu gln ala val cys gly asp
CAG CCT GTG CTA CGG CGA CAT GGA GAA CAA GCT GTT TGC GGG GAT
              800                      807
ser ala gly arg ala ala pro ala phe gly gly OP
TCG GCG GGA CGG GCT GCT CCT GCG TTT GGT GGA TGA TTTCTTGTTGGT
GACACCTCACCTCACCCACGCGAAAACCTTCCTCAGGACCCTGGTCCGAGGTGTCCCTGA
GTATGGCTGCGTGGTGAACTTGCGGAAGACAGTGGTGAACTTCCCTGTAGAAGACGAGGC
CCTGGGTGGCACGGCTTTTGTTCAGATGCCGGCCCACGGCCTATTCCCCTGGTGCGGCCT
GCTGCTGGATACCCGGACCCTGGAGGTGCAGAGCGACTACTCCAGCTATGCCCGGACCTC
CATCAGAGCCAGTCTCACCTTCAACCGCGGCTTCAAGGCTGGGAGGAACATGCGTCGCAA
ACTCTTTGGGGTCTTGCGGCTGAAGTGTCACAGCCTGTTTCTGGATTTGCAGGTGAACAG
CCTCCAGACGGTGTGCACCAACATCTACAAGATCCTCCTGCTGCAGGCGTACAGGTTTCA
CGCATGTGTGCTGCAGCTCCCATTTCATCAGCAAGTTTGGAAGAACCCCACATTTTTCCT
GCGCGTCATCTCTGACACGGCCTCCCTCTGCTACTCCATCCTGAAAGCCAAGAACGCAGG
GATGTCGCTGGGGGCCAAGGGCGCCGCCGGCCCTCTGCCCTCCGAGGCCGTGCAGTGGCT
GTGCCACCAAGCATTCCTGCTCAAGCTGACTCGACACCGTGTCACCTACGTGCCACTCCT
GGGGTCACTCAGGACAGCCCAGACGCAGCTGAGTCGGAAGCTCCCGGGGACGACGCTGAC
TGCCCTGGAGGCCGCAGCCAACCCGGCACTGCCCTCAGACTTCAAGACCATCCTGGACTG
ATGGCCACCCGCCCACAGCCAGGCCGAGAGCAGACACCAGCAGCCCTGTCACGCCGGGCT
CTACGTCCCAGGGAGGGAGGGGCGGCCCACACCCAGGCCCGCACCGCTGGGAGTCTGAGG
CCTGAGTGAGTGTTTGGCCGAGGCCTGCATGTCCGGCTGAAGGCTGAGTGTCCGGCTGAG
GCCTGAGCGAGTGTCCAGCCAAGGGCTGAGTGTCCAGCACACCTGCCGTCTTCACTTCCC
CACAGGCTGGCGCTCGGCTCCACCCCAGGGCCAGCTTTTCCTCACCAGGAGCCCGGCTTC
CACTCCCCACATAGGAATAGTCCATCCCCAGATTCGCCATTGTTCACCCCTCGCCCTGCC
CTCCTTTGCCTTCCACCCCCACCATCCAGGTGGAGACCCTGAGAAGGACCCTGGGAGCTC
TGGGAATTTGGAGTGACCAAAGGTGTGCCCTGTACACAGGCGAGGACCCTGCACCTGGAT
GGGGGTCCCTGTGGGTCAAATTGGGGGGAGGTGCTGTGGGAGTAAAATACTGAATATATG
AGTTTTTCAGTTTTGAAAAAAAAAAAAAAAAAAAAAAAAAAAAAA
```

FIG. 20E

```
  1 CCATGGGACCCACTGCAGGGGCAGCTGGGAGGCTGCAGGCTTCAGGTCCCAGTGGGGTTG
    GGTACCCTGGGTGACGTCCCCGTCGACCCTCCGACGTCCAAGTCCAGGGTCACCCCAAC

61 CCATCTGCCAGTAGAAACCTGATGTAGAATCAGGGCGCGAGTGTGGACACTGTCCTGAAT
    GGTAGACGGTCATCTTTGGACTACATCTTAGTCCCGCGCTCACACCTGTGACAGGACTTA

121 CTCAATGTCTCAGTGTGTGCTGAAACATGTAGAAATTAAAGTCCATCCCTCCTACTCTAC
    GAGTTACAGAGTCACACACGACTTTGTACATCTTTAATTTCAGGTAGGGAGGATGAGATG

181 TGGGATTGAGCCCCTTCCCTATCCCCCCCAGGGGCAGAGGAGTTCCTCTCACTCCTGTG
    ACCCTAACTCGGGGAAGGGATAGGGGGGGGTCCCCGTCTCCTCAAGGAGAGTGAGGACAC

241 GAGGAAGGAATGATACTTTGTTATTTTTCACTGCTGGTACTGAATCCACTGTTTCATTTG
    CTCCTTCCTTACTATGAAACAATAAAAGTGACGACCATGACTTAGGTGACAAAGTAAAC

******************************************
301 TTGGTTTGTTTGTTTTGTTTTGAGAGGCGGTTTCACTCTTGTTGCTCAGGCTGGAGGGAG
    AACCAAACAAACAAAACAAAACTCTCCGCCAAAGTGAGAACAACGAGTCCGACCTCCCTC

************************************************************
361 TGCAATGGCGCGATCTTGGCTTACTGCAGCCTCTGCCTCCCAGGTTCAAGTGATTCTCCT
    ACGTTACCGCGCTAGAACCGAATGACGTCGGAGACGGAGGGTCCAAGTTCACTAAGAGGA
                                                          alu
    ************************************************************
421 GCTTCCGCCTCCCATTTGGCTGGGATTACAGGCACCCGCCACCATGCCCAGCTAATTTTT
    CGAAGGCGGAGGGTAAACCGACCCTAATGTCCGTGGGCGGTGGTACGGGTCGATTAAAAA ==
    ************************************************************
481 TGTATTTTTAGTAGAGACGGGGGTGGGGGTGGGGTTCACCATGTTGGCCAGGCTGGTCTC
    ACATAAAAATCATCTCTGCCCCCACCCCCACCCCAAGTGGTACAACCGGTCCGACCAGAG CAP
    =============>
    ************************************************************
541 GAACTTCTGACCTCAGATGATCCACCTGCCTCTGCCTCCTAAAGTGCTGGGATTACAGGT
    CTTGAAGACTGGAGTCTACTAGGTGGACGGAGACGGAGGATTTCACGACCCTAATGTCCA

*******************
601 GTGAGCCACCATGCCCAGCTCAGAATTTACTCTGTTTAGAAACATCTGGGTCTGAGGTAG
    CACTCGGTGGTACGGGTCGAGTCTTAAATGAGACAAATCTTTGTAGACCCAGACTCCATC
                                                 CCAAT
                                            ***************>
661 GAAGCTCACCCCACTCAAGTGTTGTGGTGTTTAAGCCAATGATAGAATTTTTTTATTGT
    CTTCGAGTGGGGTGAGTTCACAACACCACAAAATTCGGTTACTATCTTAAAAAAATAACA

721 TGTTAGAACACTCTTGATGTTTTACACTGTGATGACTAAGACATCATCAGCTTTTCAAAG
    ACAATCTTGTGAGAACTACAAAATGTGACACTACTGATTCTGTAGTAGTCGAAAAGTTTC
```

FIG. 21A

```
                                CAP
                      **************>
 781  ACACACTAACTGCACCCATAATACTGGGGTGTCTTCTGGGTATCAGCGATCTTCATTGAA
      TGTGTGATTGACGTGGGTATTATGACCCCACAGAAGACCCATAGTCGCTAGAAGTAACTT

CAP
                                             ***********
 841  TGCCGGGAGGCGTTTCCTCGCCATGCACATGGTGTTAATTACTCCAGCATAATCTTCTGC
      ACGGCCCTCCGCAAAGGAGCGGTACGTGTACCACAATTAATGAGGTCGTATTAGAAGACG

***>
 901  TTCCATTTCTTCTCTTCCCTCTTTTAAAATTGTGTTTTCTATGTTGGCTTCTCTGCAGAG
      AAGGTAAAGAAGAGAAGGGAGAAAATTTTAACACAAAAGATACAACCGAAGAGACGTCTC

CAP
           **************>
 961  AACCAGTGTAAGCTACAACTTAACTTTTGTTGGAACAAATTTTCCAAACCGCCCCTTTGC
      TTGGTCACATTCGATGTTGAATTGAAAACAACCTTGTTTAAAAGGTTTGGCGGGGAAACG

1021  CCTAGTGGCAGAGACAATTCACAAACACAGCCCTTTAAAAAGGCTTAGGGATCACTAAGG
      GGATCACCGTCTCTGTTAAGTGTTTGTGTCGGGAAATTTTCCGAATCCCTAGTGATTCC

1081  GGATTTCTAGAAGAGCGACCCGTAATCCTTAAGTATTTACAAGACGAGGCTAACCTCCAG
      CCTAAAGATCTTCTCGCTGGGCATTAGGAATTCATAAATGTTCTGCTCCGATTGGAGGTC

1141  CGAGCGTGACAGCCCAGGGAGGGTGCGAGGCCTGTTCAAATGCTAAGCTTCCATAAATAA
      GCTCGCACTGTCGGGTCCCTCCCACGCTCCGGACAAGTTTACGATTCGAAGGTATTTATT

1201  AGCAAATTTCCTCCGGCAGTTTCTGGAAAGTAGGAAAGGTTAACATTTAAGGTTGCGTTT
      TCGTTTAAAGGAGGCCGTCAAAGACCTTTCATCCTTTCCAATTGTAAATTCCAACGCAAA

1261  GTTAGCATTTCAGTGTTTGCCGACCTCAGCTAACAGCATCCCTGCAAGGCCTCGGGAGAC
      CAATCGTAAAGTCACAAACGGCTGGAGTCGATTGTCGTAGGGACGTTCCGGAGCCCTCTG

1321  CCAGAAGTTTCTCGCCCCTTAGATCCAAACTTGAGCAACCCGGAGTCTGGATTCCTGGGA
      GGTCTTCAAAGAGCGGGGAATCTAGGTTTGAACTCGTTGGGCCTCAGACCTAAGGACCCT

TopoII
           *****************>
1381  AGTCCTCAGCTGTCCTGCGGTTGTGCCGGGGCCCCAGGTCTGGAGGGGACCAGTGGCCGT
      TCAGGAGTCGACAGGACGCCAACACGGCCCCGGGGTCCAGACCTCCCCTGGTCACCGGCA 1441  GTGGCTTCTACTGCTGGGCTGGAAGTCGGGCCTCCTAGCTCTGCAGTCCGAGGCTTGGAG
      CACCGAAGATGACGACCCGACCTTCAGCCCGGAGGATCGAGACGTCAGGCTCCGAACCTC 1501  CCAGGTGCCTGGACCCCGAGGCTGCCCTCCACCCTGTGCGGGCGGGATGTGACCAGATGT
      GGTCCACGGACCTGGGGCTCCGACGGGAGGTGGGACACGCCCGCCCTACACTGGTCTACA 1561  TGGCCTCATCTGCCAGACAGAGTGCCGGGGCCCAGGGTCAAGGCCGTTGTGGCTGGTGTG
      ACCGGAGTAGACGGTCTGTCTCACGGCCCCGGGTCCCAGTTCCGGCAACACCGACCACAC 1621  AGGCGCCCGGTGCGCGGCCAGCAGGAGCGCCTGGCTCCATTTCCCACCCTTTCTCGACGG
      TCCGCGGGCCACGCGCCGGTCGTCCTCGCGGACCGAGGTAAAGGGTGGGAAAGAGCTGCC
```

FIG. 21B

```
1681 GACCGCCCCGGTGGGTGATTAACAGATATTGGGGTGGTTTGCTCATGGTGGGGACCCCTT
     CTGGCGGGGCCACCCACTAATTGTCTATAACCCCACCAAACGAGTACCACCCCTGGGGAA

1741 CGCCGCCTGAGAACCTGCAAAGAGAAATGACGGGCCTGTGTCAAGGAGCCCAAGTCGCGG
     GCGGCGGACTCTTGGACGTTTCTCTTTACTGCCCGGACACAGTTCCTCGGGTTCAGCGCC

1801 GGAAGTGTTGCAGGGAGGCACTCCGGGAGGTCCCGCGTGCCCGTCCAGGGAGCAATGCGT
     CCTTCACAACGTCCCTCCGTGAGGCCCTCCAGGGCGCACGGGCAGGTCCCTCGTTACGCA

1861 CCTCGGGTTCGTCCCCAGCCGCGTCTACGCGCCTCCGTCCTCCCCTTCACGTCCGGCATT
     GGAGCCCAAGCAGGGGTCGGCGCAGATGCGCGGAGGCAGGAGGGGAAGTGCAGGCCGTAA

1921 CGTGGTGCCCGGAGCCCGACGCCCCGCGTCCGGACCTGGAGGCAGCCCTGGGTCTCCGGA
     GCACCACGGGCCTCGGGCTGCGGGGCGCAGGCCTGGACCTCCGTCGGGACCCAGAGGCCT

1981 TCAGGCCAGCGGCCAAAGGGTCGCCGCACGCACCTGTTCCCAGGGCCTCCACATCATGGC
     AGTCCGGTCGCCGGTTTCCCAGCGGCGTGCGTGGACAAGGGTCCCGGAGGTGTAGTACCG

2041 CCCTCCCTCGGGTTACCCCACAGCCTAGGCCGATTCGACCTCTCTCCGCTGGGGCCCTCG
     GGGAGGGAGCCCAATGGGGTGTCGGATCCGGCTAAGCTGGAGAGAGGCGACCCCGGGAGC

Sp1
                                          ********
2101 CTGGCGTCCCTGCACCCTGGGAGCGCGAGCGGCGCGCGGGCGGGGAAGCGCGGCCCAGAC
     GACCGCAGGGACGTGGGACCCTCGCGCTCGCCGCGCGCCCGCCCCTTCGCGCCGGGTCTG

2161 CCCCGGGTCCGCCCGGAGCAGCTGCGCTGTCGGGGCCAGGCCGGGCTCCCAGTGGATTCG
     GGGGCCCAGGCGGGCCTCGTCGACGCGACAGCCCCGGTCCGGCCCGAGGGTCACCTAAGC

2221 CGGGCAACAGACGCCCAGGACCGCGCTTCCCACGTGGCGGAGGGACTGGGGACCCGGGCA
     GCCCGTTGTCTGCGGGTCCTGGCGCGAAGGGTGCACCGCCTCCCTGACCCCTGGGCCCGT

Sp1
                                          ========
                                           E2F
                                       ********
2281 CCGGTCCTGCCCCTTCACCTTCCAGCTCCGCCTCGTCCGCGCGGAACCCCGCCCCGTCCC
     GGCCAGGACGGGGAAGTGGAAGGTCGAGGCGGAGCAGGCGCGCCTTGGGGCGGGGCAGGG

2341 GAACCCTTCCCGGGTCCCCGGCCCAGCCCCTTCCGGGCCATCCCAGCCCGTCCCGTTCCT
     CTTGGGAAGGGCCCAGGGGCCGGGTCGGGGAAGGCCCGGTAGGGTCGGGCAGGGCAAGGA

Sp1
         ========
     E2F                         NFkB
     ********                ********  ******************
2401 TTTCCGCGGCCCCGCCCTCTCCTCGCGGCGCGAGTTTCAGGCAGCGCTGCGTCCTGCTGC
     AAAGGCGCCGGGGCGGGAGAGGAGCGCCGCGCTCAAAGTCCGTCGCGACGCAGGACGACG hTRT5'
     **************************>
2461 GCACGTGGGAAGCCCTGGCCCCGGCCACCCCCGCGATGCCGCGCGCTCCCCGCTGCCGAG
     CGTGCACCCTTCGGGACCGGGGCCGGTGGGGCGCTACGGCGCGCGAGGGGCGACGGCTC

2521 CCGTGCGCTCCCTGCTGCGCAGCCACTACCGCGAGGTGCTGCCGCTGGCCACGTTCGTGC
     GGCACGCGAGGGACGACGCGTCGGTGATGGCGCTCCACGACGGCGACCGGTGCAAGCACG
```

FIG. 21C

```
                                                                    E2F
                                                                 ******
2581 GGCGCCTGGGGCCCCAGGGCTGGCGGCTGGTGCAGCGCGGGGACCCGGCGGCTTTCCGCG
     CCGCGGACCCCGGGGTCCCGACCGCCGACCACGTCGCGCCCCTGGGCCGCCGAAAGGCGC

*
2641 CGCTGGTGGCCCAGTGCCTGGTGTGCGTGCCCTGGGACGCACGGCCGCCCCCCGCCGCCC
     GCGACCACCGGGTCACGGACCACACGCACGGGACCCTGCGTGCCGGCGGGGGGCGGCGGG

NFkB
                    ==========

**************************************************
2701 CCTCCTTCCGCCAGGTGGGCCTCCCCGGGGTCGGCGTCCGGCTGGGGTTGAGGGCGGCCG
     GGAGGAAGGCGGTCCACCCGGAGGGGCCCCAGCCGCAGGCCGACCCCAACTCCCGCCGGC

Topo_II_cleavag
                                                    ::::::::::::::
                                                   NFkB
                                              ++++++++++
                                                   NFkB
                                              ==========
         Intron1
     **********************************************************>
2761 GGGGGAACCAGCGACATGCGGAGAGCAGCGCAGGCGACTCAGGGCGCTTCCCCCGCAGGT
     CCCCCTTGGTCGCTGTACGCCTCTCGTCGCGTCCGCTGAGTCCCGCGAAGGGGCGTCCA e_site
     ::::
2821 GTCCTGCCTGAAGGAGCTGGTGGCCCGAGTGCTGCAGAGGCTGTGCGAGCGCGGCGCGAA
     CAGGACGGACTTCCTCGACCACCGGGCTCACGACGTCTCCGACACGCTCGCGCCGCGCTT 2881 GAACGTGCTGGCCTTCGGCTTCGCGCTGCTGGACGGGGCCCGCGGGGGCCCCCCCGAGGC
     CTTGCACGACCGGAAGCCGAAGCGCGACGACCTGCCCCGGGCGCCCCCGGGGGGGCTCCG 2941 CTTCACCACCAGCGTGCGCAGCTACCTGCCCAACACGGTGACCGACGCACTGCGGGGGAG
     GAAGTGGTGGTCGCACGCGTCGATGGACGGGTTGTGCCACTGGCTGCGTGACGCCCCCTC 3001 CGGGGCGTGGGGGCTGCTGCTGCGCCGCGTGGGCGACGACGTGCTGGTTCACCTGCTGGC
     GCCCCGCACCCCCGACGACGACGCGGCGCACCCGCTGCTGCACGACCAAGTGGACGACCG 3061 ACGCTGCGCGCTCTTTGTGCTGGTGGCTCCCAGCTGCGCCTACCAGGTGTGCGGGCCGCC
     TGCGACGCGCGAGAAACACGACCACCGAGGGTCGACGCGGATGGTCCACACGCCCGGCGG 3121 GCTGTACCAGCTCGGCGCTGCCACTCAGGCCCGGCCCCCGCCACACGCTAGTGGACCCCG
     CGACATGGTCGAGCCGCGACGGTGAGTCCGGGCCGGGGCGGTGTGCGATCACCTGGGGC 3181 AAGGCGTCTGGGATGCGAACGGGCCTGGAACCATAGCGTCAGGGAGGCCGGGGTCCCCCT
     TTCCGCAGACCCTACGCTTGCCCGGACCTTGGTATCGCAGTCCCTCCGGCCCCAGGGGGA 3241 GGGCCTGCCAGCCCCGGGTGCGAGGAGGCGCGGGGGCAGTGCCAGCCGAAGTCTGCCGTT
     CCCGGACGGTCGGGGCCCACGCTCCTCCGCGCCCCCGTCACGGTCGGCTTCAGACGGCAA 3301 GCCCAAGAGGCCCAGGCGTGGCGCTGCCCCTGAGCCGGAGCGGACGCCCGTTGGGCAGGG
     CGGGTTCTCCGGGTCCGCACCGCGACGGGGACTCGGCCTCGCCTGCGGGCAACCCGTCCC
```

FIG. 21D

```
3361 GTCCTGGGCCCACCCGGGCAGGACGCGTGGACCGAGTGACCGTGGTTTCTGTGTGGTGTC
     CAGGACCCGGGTGGGCCCGTCCTGCGCACCTGGCTCACTGGCACCAAAGACACACCACAG

3421 ACCTGCCAGACCCGCCGAAGAAGCCACCTCTTTGGAGGGTGCGCTCTCTGGCACGCGCCA
     TGGACGGTCTGGGCGGCTTCTTCGGTGGAGAAACCTCCCACGCGAGAGACCGTGCGCGGT

3481 CTCCCACCCATCCGTGGGCCGCCAGCACCACGCGGGCCCCCCATCCACATCGCGGCCACC
     GAGGGTGGGTAGGCACCCGGCGGTCGTGGTGCGCCCGGGGGGTAGGTGTAGCGCCGGTGG

3541 ACGTCCCTGGGACACGCCTTGTCCCCGGTGTACGCCGAGACCAAGCACTTCCTCTACTC
     TGCAGGGACCCTGTGCGGAACAGGGGGCCACATGCGGCTCTGGTTCGTGAAGGAGATGAG

3601 CTCAGGCGACAAGGAGCAGCTGCGGCCCTCCTTCCTACTCAGCTCTCTGAGGCCCAGCCT
     GAGTCCGCTGTTCCTCGTCGACGCCGGGAGGAAGGATGAGTCGAGAGACTCCGGGTCGGA

3661 GACTGGCGCTCGGAGGCTCGTGGAGACCATCTTTCTGGGTTCCAGGCCCTGGATGCCAGG
     CTGACCGCGAGCCTCCGAGCACCTCTGGTAGAAAGACCCAAGGTCCGGGACCTACGGTCC

3721 GACTCCCCGCAGGTTGCCCCGCCTGCCCCAGCGCTACTGGCAAATGCGGCCCCTGTTTCT
     CTGAGGGGCGTCCAACGGGGCGGACGGGGTCGCGATGACCGTTTACGCCGGGGACAAAGA

3781 GGAGCTGCTTGGGAACCACGCGCAGTGCCCCTACGGGGTGCTCCTCAAGACGCACTGCCC
     CCTCGACGAACCCTTGGTGCGCGTCACGGGGATGCCCCACGAGGAGTTCTGCGTGACGGG

3841 GCTGCGAGCTGCGGTCACCCCAGCAGCCGGTGTCTGTGCCCGGGAGAAGCCCCAGGGCTC
     CGACGCTCGACGCCAGTGGGGTCGTCGGCCACAGACACGGGCCCTCTTCGGGGTCCCGAG

3901 TGTGGCGGCCCCCGAGGAGGAGGACACAGACCCCCGTCGCCTGGTGCAGCTGCTCCGCCA
     ACACCGCCGGGGGCTCCTCCTCCTGTGTCTGGGGGCAGCGGACCACGTCGACGAGGCGGT

3961 GCACAGCAGCCCCTGGCAGGTGTACGGCTTCGTGCGGGCCTGCCTGCGCCGGCTGGTGCC
     CGTGTCGTCGGGGACCGTCCACATGCCGAAGCACGCCCGGACGGACGCGGCCGACCACGG

4021 CCCAGGCCTCTGGGGCTCCAGGCACAACGAACGCCGCTTCCTCAGGAACACCAAGAAGTT
     GGGTCCGGAGACCCCGAGGTCCGTGTTGCTTGCGGCGAAGGAGTCCTTGTGGTTCTTCAA

4081 CATCTCCCTGGGGAAGCATGCCAAGCTCTCGCTGCAGGAGCTGACGTGGAAGATGAGCGT
     GTAGAGGGACCCCTTCGTACGGTTCGAGAGCGACGTCCTCGACTGCACCTTCTACTCGCA

***************************
4141 GCGGGACTGCGCTTGGCTGCGCAGGAGCCCAGGTGAGGAGGTGGTGGCCGTCGAGGGCCC
     CGCCCTGACGCGAACCGACGCGTCCTCGGGTCCACTCCTCCACCACCGGCAGCTCCCGGG

Intron2
     ************************************************************
4201 AGGCCCCAGAGCTGAATGCAGTAGGGGCTCAGAAAAGGGGGCAGGCAGAGCCCTGGTCCT
     TCCGGGGTCTCGACTTACGTCATCCCCGAGTCTTTTCCCCCGTCCGTCTCGGGACCAGGA

************************************************************
4261 CCTGTCTCCATCGTCACGTGGGCACACGTGGCTTTTCGCTCAGGACGTCGAGTGGACACG
     GGACAGAGGTAGCAGTGCACCCGTGTGCACCGAAAAGCGAGTCCTGCAGCTCACCTGTGC

*****>
4321 GTGATCGAGGTCGAC
     CACTAGCTCCAGCTG
```

*FIG. 21E*

```
gccaagttcctgcactggctgatgagtgtgtacgtcgtcgagctgctcaggtctttctttt
tatgtcacggagaccacgtttcaaaagaacaggctcttttctaccggaagagtgtctgg
agcaagttgcaaagcattggaatcagacagcacttgaagagggtgcagctgcgggacgtg
tcggaagcagaggtcaggcagcatcgggaagccaggcccgccctgctgacgtccagactc
cgcttcatcccaagcctgacgggctgcggccgattgtgaacatggactacgtcgtggga
gccagaacgttccgcagagaaaagagggccgagcgtctcacctcgagggtgaaggcactg
ttcagcgtgctcaactacgagcgggcgcg
```

FIG. 23

```
TCTACCTTGACAGACCTCCAGCCGTACATGCGACAGTTCGTGGCTCACCTGCAGGAG
ACCAGCCCGCTGAGGGATGCCGTCGTCATCGAGCAGAGCTCCTCCCTGAATGAGGCC
AGCAGTGGCCTCTTCGACGTCTTCCTACGCTTCATGTGCCACCACGCCGTGCGCATC
AGGGGCAAGTC
```

FIG. 24

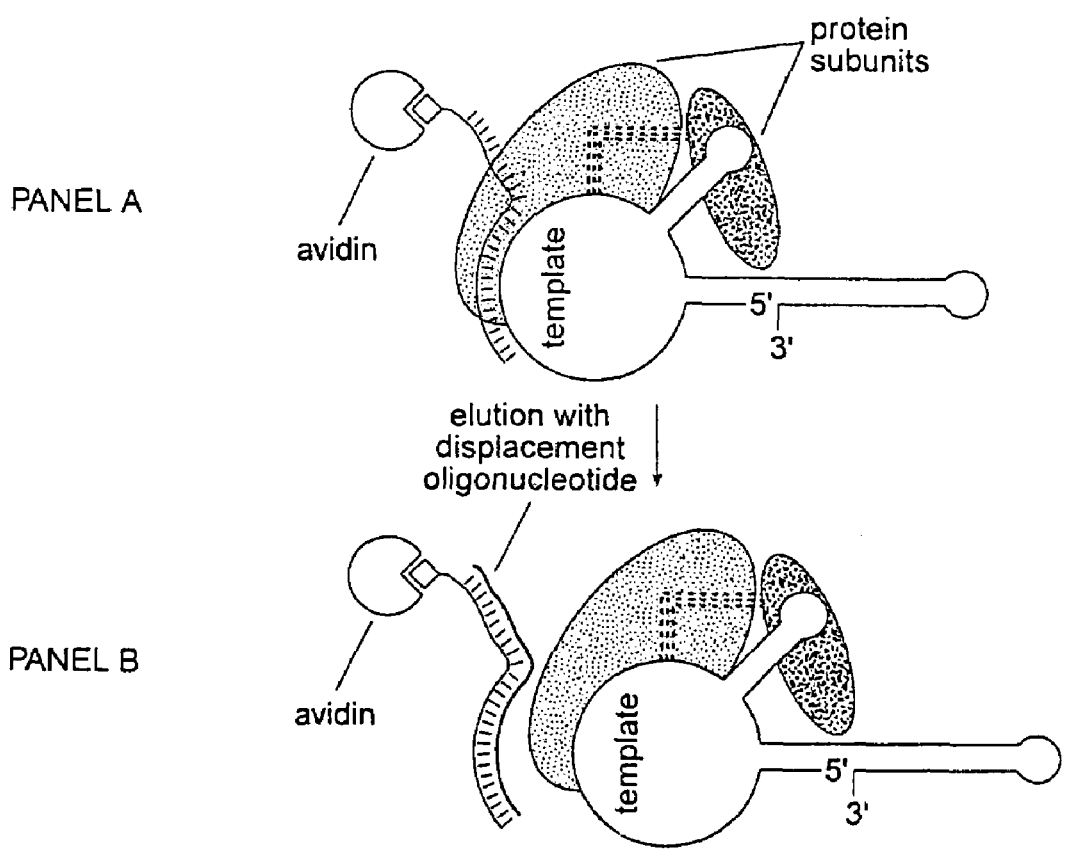

FIG. 26

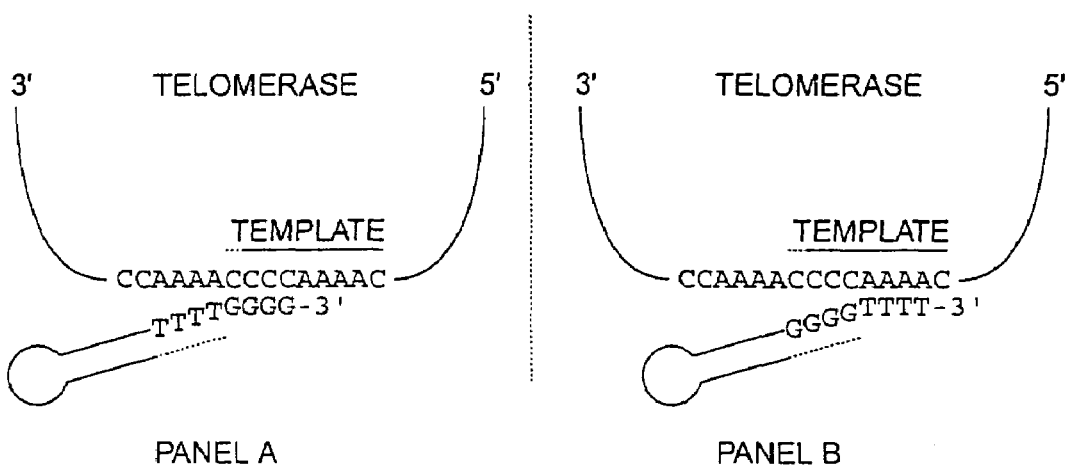

FIG. 32

```
   1  CCCCAAAACC CCAAAACCCC AAAACCCCTA TAAAAAAGA AAAAATTGAG
  51  GTAGTTTAGA AATAAAATAT TATTCCCGCA CAAATGGAGA TGGATATTGA
 101  TTTGGATGAT ATAGAAAATT TACTTCCTAA TACATTCAAC AAGTATAGCA
 151  GCTCTTGTAG TGACAAGAAA GGATGCAAAA CATTGAAATC TGGCTCGAAA
 201  TCGCCTTCAT TGACTATTCC AAAGTTGCAA AACAATTAG AGTTCTACTT
 251  CTCGGATGCA AATCTTTATA ACGATTCTTT CTTGAGAAAA TTAGTTTTAA
 301  AAAGCGGAGA GCAAAGAGTA GAAATTGAAA CATTACTAAT GTTTAAATAA
 351  AATCAGGTAA TGAGGATTAT TCTATTTTTT AGATCACTTC TTAAGGAGCA
 401  TTATGGAGAA AATTACTTAA TACTAAAAGG TAAACAGTTT GGATTATTTC
 451  CCTAGCCAAC AATGATGAGT ATATTAAATT CATATGAGAA TGAGTCAAAG
 501  GATCTCGATA CATCAGACTT ACCAAAGACA AACTCGCTAT AAAACGCAAG
 551  AAAAAGTTTG ATAATCGAAC AGCAGAAGAA CTTATTGCAT TTACTATTCG
 601  TATGGGTTTT ATTACAATTG TTTTAGGTAT CGACGGTGAA CTCCCGAGTC
 651  TTGAGACAAT TGAAAAAGCT GTTTACAACT GAAGGAATCG CAGTTCTGAA
 701  AGTTCTGATG TGTATGCCAT TATTTTGTGA ATTAATCTCA AATATCTTAT
 751  CTCAATTTAA TGGATAGCTA TAGAAACAAA CCAAATAAAC CATGCAAGTT
 801  TAATGGAATA TACGTTAAAT CCTTTGGGAC AAATGCACAC TGAATTTATA
 851  TTGGATTCTT AAAGCATAGA TACACAGAAT GCTTTAGAGA CTGATTTAGC
 901  TTACAACAGA TTACCTGTTT TGATTACTCT TGCTCATCTC TTATATCTTT
 951  AAAAGAAGCA GGCGAAATGA AAGAAGACT AAAGAAAGAG ATTTCAAAAT
1001  TTGTTGATTC TTCTGTAACC GGAATTAACA ACAAGAATAT TAGCAACGAA
1051  AAAGAAGAAG AGCTATCACA ATCCTGATTC TTAAAGATTT CAAAAATTCC
1101  AGGTAAGAGA GATACATTCA TTAAAATTCA TATATTATAG TTTTTCATTT
1151  CACAGCTGTT ATTTTCTTTT ATCTTAACAA TATTTTTTGA TTAGCTGGAA
1201  GTAAAAAGTA TCAAATAAGA GAAGCGCTAG ACTGAGGTAA CTTAGCTTAT
1251  TCACATTCAT AGATCGACCT TCATATATCC AATACGATGA TAAGGAAACA
1301  GCAGTCATCC GTTTTAAAAA TAGTGCTATG AGGACTAAAT TTTTAGAGTC
1351  AAGAAATGGA GCCGAAATCT TAATCAAAAA GAATTGCGTC GATATTGCAA
1401  AAGAATCGAA CTCTAAATCT TTCGTTAATA AGTATTACCA ATCTTGATTG
1451  ATTGAAGAGA TTGACGAGGC AACTGCACAG AAGATCATTA AAGAAATAAA
1501  GTAACTTTTA TTAATTAGAG AATAAACTAA ATTACTAATA TAGAGATCAG
1551  CGATCTTCAA TTGACGAAAT AAAAGCTGAA CTAAAGTTAG ACAATAAAAA
1601  ATACAAACCT TGGTCAAAAT ATTGAGGAAG GAAAAGAAGA CCAGTTAGCA
1651  AAAGAAAAAA TAAGGCAATA AATAAAATGA GTACAGAAGT GAAGAAATAA
1701  AAGATTTATT TTTTCAATA ATTTATTGAA AAGAGGGGTT TTGGGGTTTT
1751  GGGGTTTTGG GG
```

FIG. 34

```
       CCCCAAAACCCCAAAACCCCAAAACCCCTATAAAAAAAGAAAAAATTGAGGTAGTTTAGA
     1 ---------+---------+---------+---------+---------+---------+ 60
       GGGGTTTTGGGGTTTTGGGGTTTTGGGGATATTTTTTCTTTTTTAACTCCATCAAATCT a    P   Q   N   P   K   T   P   K   P   L   *   K   K   K   K   L   R   *   F   R  -
b      P   K   T   P   K   P   Q   N   P   Y   K   K   R   K   N   C   G   S   L   E -
c        P   K   P   Q   N   P   K   T   P   I   K   K   E   K   I   E   V   V   *   K-

AATAAAATATTATTCCCGCACAAATGGAGATGGATATTGATTTGGATGATATAGAAAATT
    61 ---------+---------+---------+---------+---------+---------+ 120
       TTATTTTATAATAAGGGCGTGTTTACCTCTACCTATAACTAAACCTACTATATCTTTTAA a    N   K   I   L   F   P   H   K   W   R   W   I   L   I   W   M   I   *   K   I  -
b      I   K   Y   Y   S   R   T   N   G   D   G   Y   C   F   G   C   Y   R   K   F -
c        *   N   I   I   P   A   Q   M   E   M   D   I   D   L   D   D   I   E   N   L-

TACTTCCTAATACATTCAACAAGTATAGCAGCTCTTGTAGTGACAAGAAAGGATGCAAAA
   121 ---------+---------+---------+---------+---------+---------+ 180
       ATGAAGGATTATGTAAGTTGTTCATATCGTCGAGAACATCACTGTTCTTTCCTACGTTTT a    Y   F   L   I   H   S   T   S   I   A   A   L   V   V   T   R   K   D   A   K  -
b      T   S   *   Y   I   Q   Q   V   *   Q   L   L   *   C   Q   E   R   M   Q   N -
c        L   P   N   T   F   N   K   Y   S   S   S   C   S   D   K   K   G   C   K   T-

CATTGAAATCTGGCTCGAAATCGCCTTCATTGACTATTCCAAAGTTGCAAAAACAATTAG
   181 ---------+---------+---------+---------+---------+---------+ 240
       GTAACTTTAGACCGAGCTTTAGCGGAAGTAACTGATAAGGTTTCAACGTTTTTGTTAATC a    H   C   N   L   A   R   N   R   L   H   C   L   F   Q   S   C   K   N   N   *  -
b      I   E   I   W   L   E   I   A   F   I   D   Y   S   K   V   A   K   T   I   R -
c        L   K   S   G   S   K   S   P   S   L   T   I   P   K   L   Q   K   Q   L   E-

AGTTCTACTTCTCGGATGCAAATCTTTATAACGATTCTTTCTTGAGAAAATTAGTTTTAA
   241 ---------+---------+---------+---------+---------+---------+ 300
       TCAAGATGAAGAGCCTACGTTTAGAAATATTGCTAAGAAAGAACTCTTTTAATCAAAATT a    S   S   T   S   R   M   Q   I   F   I   T   I   L   S   C   E   N   *   F   *  -
b      V   L   L   L   G   C   K   S   L   *   R   F   F   L   E   K   I   S   F   K -
c        F   Y   F   S   D   A   N   L   Y   N   D   S   F   L   R   K   L   V   L   K-

AAAGCGGAGAGCAAAGAGTAGAAATTGAAACATTACTAATGTTTAAATAAAATCAGGTAA
   301 ---------+---------+---------+---------+---------+---------+ 360
       TTTCGCCTCTCGTTTCTCATCTTTAACTTTGTAATGATTACAAATTTATTTTAGTCCATT a    K   A   E   S   K   E   *   K   L   K   H   Y   *   C   L   N   K   I   R   *  -
b      K   R   R   A   K   S   R   N   C   N   I   T   N   V   *   I   K   S   G   N -
c        S   G   E   Q   R   V   E   I   E   T   L   L   M   F   K   *   N   Q   V   M-

TGAGGATTATTCTATTTTTTAGATCACTTCTTAAGGAGCATTATGGAGAAAATTACTTAA
   361 ---------+---------+---------+---------+---------+---------+ 420
       ACTCCTAATAAGATAAAAAATCTAGTGAAGAATTCCTCGTAATACCTCTTTTAATGAATT a    C   G   L   F   Y   F   L   D   H   F   L   R   S   I   M   E   K   I   T   *  -
b      E   D   Y   S   I   F   *   I   T   S   *   G   A   L   W   R   K   L   L   N -
c        R   I   I   L   F   F   R   S   L   L   K   E   H   Y   G   E   N   Y   L   I-
```

FIG. 35A

```
            TACTAAAAGGTAAACAGTTTGGATTATTTCCCTAGCCAACAATGATGAGTATATTAAATT
    421     ---------+---------+---------+---------+---------+---------+   480
            ATGATTTTCCATTTGTCAAACCTAATAAAGGGATCGGTTGTTACTACTCATATAATTTAA a    Y  *  K  V  N  S  L  D  Y  F  P  S  Q  Q  C  C  V  Y  *  I  -
    b    T  K  R  *  T  V  W  I  I  S  L  A  N  N  D  E  Y  I  K  F  -
    c       L  K  G  K  Q  F  G  L  F  P  *  P  T  M  M  S  I  L  N  S -

CATATGAGAATGAGTCAAAGGATCTCGATACATCAGACTTACCAAAGACAAACTCGCTAT
    481     ---------+---------+---------+---------+---------+---------+   540
            GTATACTCTTACTCAGTTTCCTAGAGCTATGTAGTCTGAATGGTTTCTGTTTGAGCGATA a    H  M  R  M  S  Q  R  I  S  I  H  Q  T  Y  Q  R  Q  T  R  Y  -
    b    I  C  E  C  V  K  G  S  R  Y  I  R  L  T  K  D  K  L  A  I  -
    c       Y  E  N  E  S  K  D  L  D  T  S  D  L  P  K  T  N  S  L  * -

AAAACGCAAGAAAAAGTTTGATAATCGAACAGCAGAAGAACTTATTGCATTTACTATTCG
    541     ---------+---------+---------+---------+---------+---------+   600
            TTTTGCGTTCTTTTTCAAACTATTAGCTTGTCGTCTTCTTGAATAACGTAAATGATAAGC a    K  T  Q  E  K  V  C  *  S  N  S  R  R  T  Y  C  I  Y  Y  S  -
    b    K  R  K  K  K  F  D  N  R  T  A  E  E  L  I  A  F  T  I  R  -
    c       N  A  R  K  S  L  I  I  E  Q  Q  K  N  L  L  H  L  L  F  V -

TATGGGTTTTATTACAATTGTTTTAGGTATCGACGGTGAACTCCCGAGTCTTGAGACAAT
    601     ---------+---------+---------+---------+---------+---------+   660
            ATACCCAAAATAATGTTAACAAAATCCATAGCTGCCACTTGAGGGCTCAGAACTCTGTTA a    Y  G  F  Y  Y  N  C  F  R  Y  R  R  C  T  P  E  S  C  D  N  -
    b    M  G  F  I  T  I  V  L  G  I  D  G  E  L  P  S  L  E  T  I  -
    c       W  V  L  L  Q  L  F  *  V  S  T  V  N  S  R  V  L  R  Q  L -

TGAAAAAGCTGTTTACAACTGAAGGAATCGCAGTTCTGAAAGTTCTGATGTGTATGCCAT
    661     ---------+---------+---------+---------+---------+---------+   720
            ACTTTTTCGACAAATGTTGACTTCCTTAGCGTCAAGACTTTCAAGACTACACATACGGTA a    C  K  S  C  L  Q  L  K  E  S  Q  F  C  K  F  C  C  V  C  H  -
    b    E  K  A  V  Y  N  C  R  N  R  S  S  E  S  S  D  V  Y  A  I  -
    c       K  K  L  F  T  T  E  G  I  A  V  L  K  V  L  M  C  M  P  L -

TATTTGTGAATTAATCTCAAATATCTTATCTCAATTTAATGGATAGCTATAGAAACAAA
    721     ---------+---------+---------+---------+---------+---------+   780
            ATAAACACTTAATTAGAGTTTATAGAATAGAGTTAAATTACCTATCGATATCTTTGTTT a    Y  F  V  N  *  S  Q  I  S  Y  L  N  L  M  D  S  Y  R  N  K  -
    b    I  L  C  I  N  L  K  Y  L  I  S  I  *  W  I  A  I  E  T  N  -
    c       F  C  E  L  I  S  N  I  L  S  Q  F  N  G  *  L  *  K  Q  T -

CCAAATAAACCATGCAAGTTTAATGGAATATACGTTAAATCCTTTGGGACAAATGCACAC
    781     ---------+---------+---------+---------+---------+---------+   840
            GGTTTATTTGGTACGTTCAAATTACCTTATATGCAATTTAGGAAACCCTGTTTACGTGTG a    P  N  K  P  C  K  F  N  G  I  Y  V  K  S  F  G  T  N  A  H  -
    b    Q  I  N  H  A  S  L  M  E  Y  T  L  N  P  L  G  Q  M  H  T  -
    c       K  *  T  M  Q  V  *  W  N  I  R  *  I  L  W  D  K  C  T  L -

TGAATTTATATTGGATTCTTAAAGCATAGATACACAGAATGCTTTAGAGACTGATTTAGC
    841     ---------+---------+---------+---------+---------+---------+   900
            ACTTAAATATAACCTAAGAATTTCGTATCTATGTGTCTTACGAAATCTCTGACTAAATCG a    C  I  Y  I  G  F  L  K  H  R  Y  T  E  C  F  R  D  C  F  S  -
    b    E  F  I  L  D  S  *  S  I  D  T  Q  N  A  L  E  T  D  L  A  -
    c       N  L  Y  W  I  L  K  A  *  I  H  R  M  L  *  R  L  I  *  L -
```

FIG. 35B

```
              TTACAACAGATTACCTGTTTTGATTACTCTTGCTCATCTCTTATATCTTTAAAAGAAGCA
       901   ----------+----------+----------+----------+----------+----------+  960
              AATGTTGTCTAATGGACAAAACTAATGAGAACGAGTAGAGAATATAGAAATTTTCTTCGT a      L  Q  Q  I  T  C  F  D  Y  S  C  S  S  L  I  S  L  K  E  A   -
       b       Y  N  R  L  P  V  L  I  T  L  A  H  L  L  Y  L  *  K  K  Q  -
       c        T  T  D  Y  L  F  C  L  L  L  L  I  S  Y  I  F  K  R  S  R -

GGCGAAATGAAAAGAAGACTAAAGAAAGAGATTTCAAAATTTGTTGATTCTTCTGTAACC
       961   ----------+----------+----------+----------+----------+----------+ 1020
              CCGCTTTACTTTTCTTCTGATTTCTTTCTCTAAAGTTTTAAACAACTAAGAAGACATTGG a      G  E  M  K  R  R  L  K  K  E  I  S  K  F  V  D  S  S  V  T   -
       b       A  K  C  K  E  D  *  R  K  R  F  Q  N  L  L  I  L  L  *  P  -
       c        R  N  E  K  K  T  K  E  R  D  F  K  I  C  C  F  F  C  N  R -

GGAATTAACAACAAGAATATTAGCAACGAAAAAGAAGAAGAGCTATCACAATCCTGATTC
      1021   ----------+----------+----------+----------+----------+----------+ 1080
              CCTTAATTGTTGTTCTTATAATCGTTGCTTTTTCTTCTTCTCGATAGTGTTAGGACTAAG a      G  I  N  N  K  N  I  S  N  E  K  E  E  E  L  S  Q  S  C  F   -
       b       E  L  T  T  R  I  L  A  T  K  K  K  K  S  Y  H  N  P  D  S  -
       c        N  *  Q  Q  E  Y  *  Q  R  K  R  R  R  A  I  T  I  L  I  L -

TTAAAGATTTCAAAAATTCCAGGTAAGAGAGATACATTCATTAAAATTCATATATTATAG
      1081   ----------+----------+----------+----------+----------+----------+ 1140
              AATTTCTAAAGTTTTTAAGGTCCATTCTCTCTATGTAAGTAATTTTAAGTATATAATATC a      L  K  I  S  K  I  P  G  K  R  D  T  F  I  K  I  H  I  L  *   -
       b       *  R  F  Q  K  F  Q  V  R  E  I  H  S  L  K  F  I  Y  Y  S  -
       c        K  D  F  K  N  S  R  *  E  R  Y  I  H  *  N  S  Y  I  I  V -

TTTTTCATTTCACAGCTGTTATTTTCTTTTATCTTAACAATATTTTTTGATTAGCTGGAA
      1141   ----------+----------+----------+----------+----------+----------+ 1200
              AAAAAGTAAAGTGTCGACAATAAAAGAAAATAGAATTGTTATAAAAAACTAATCGACCTT a      F  F  I  S  Q  L  L  F  S  F  I  L  T  I  F  F  D  *  L  E   -
       b       F  S  F  H  S  C  Y  F  L  L  S  *  Q  Y  F  L  I  S  W  K  -
       c        F  H  F  T  A  V  I  F  F  Y  L  N  N  I  F  C  L  A  G  S -

GTAAAAGTATCAAATAAGAGAAGCGCTAGACTGAGGTAACTTAGCTTATTCACATTCAT
      1201   ----------+----------+----------+----------+----------+----------+ 1260
              CATTTTTCATAGTTTATTCTCTTCGCGATCTGACTCCATTGAATCGAATAAGTGTAAGTA a      V  K  S  I  K  *  E  K  R  *  T  E  V  T  *  L  I  H  I  H   -
       b       *  K  V  S  N  K  R  S  A  R  L  R  *  L  S  L  F  T  F  I  -
       c        K  K  Y  Q  I  R  E  A  L  D  C  G  N  L  A  Y  S  H  S  * -

AGATCGACCTTCATATATCCAATACGATGATAAGGAAACAGCAGTCATCCGTTTTAAAAA
      1261   ----------+----------+----------+----------+----------+----------+ 1320
              TCTAGCTGGAAGTATATAGGTTATGCTACTATTCCTTTGTCGTCAGTAGGCAAAATTTTT a      R  S  T  F  I  Y  P  I  R  C  *  G  N  S  S  H  P  F  *  K   -
       b       D  R  P  S  Y  I  Q  Y  D  D  K  E  T  A  V  I  R  F  K  N  -
       c        I  D  L  H  I  S  N  T  M  I  R  K  Q  Q  S  S  V  L  K  I -

TAGTGCTATGAGGACTAAATTTTTAGAGTCAAGAAATGGAGCCGAAATCTTAATCAAAAA
      1321   ----------+----------+----------+----------+----------+----------+ 1380
              ATCACGATACTCCTGATTTAAAAATCTCAGTTCTTTACCTCGGCTTTAGAATTAGTTTTT a      *  C  Y  E  D  *  I  F  R  V  K  K  W  S  R  N  L  N  Q  K   -
       b       S  A  M  R  T  K  F  L  E  S  R  N  G  A  E  I  L  I  K  K  -
       c        V  L  C  G  L  N  F  *  S  Q  E  M  E  P  K  S  *  S  K  R -
```

FIG. 35C

```
        GAATTGCGTCGATATTGCAAAAGAATCGAACTCTAAATCTTTCGTTAATAAGTATTACCA
1381    ------------+---------+---------+---------+---------+---------+ 1440
        CTTAACGCAGCTATAACGTTTTCTTAGCTTGAGATTTAGAAAGCAATTATTCATAATGGT a     E   L   R   R   Y   C   K   R   I   E   L   *   I   F   R   *   *   V   L   P   -
b       N   C   V   D   I   A   K   E   S   N   S   K   S   F   V   N   K   Y   Y   Q   -
c         I   A   S   I   L   Q   K   N   R   T   L   N   L   S   L   I   S   I   T   N   -

ATCTTGATTGATTGAAGAGATTGACGAGGCAACTGCACAGAAGATCATTAAAGAAATAAA
1441    ------------+---------+---------+---------+---------+---------+ 1500
        TAGAACTAACTAACTTCTCTAACTGCTCCGTTGACGTGTCTTCTAGTAATTTCTTTATTT a     I   L   I   D   C   R   D   C   R   G   N   C   T   E   D   H   *   R   N   K   -
b       S   C   L   I   E   E   I   D   E   A   T   A   Q   K   I   I   K   E   I   K   -
c         L   D   C   L   K   R   L   T   R   Q   L   H   R   R   S   L   K   K   *   S   -

GTAACTTTTATTAATTAGAGAATAAACTAAATTACTAATATAGAGATCAGCGATCTTCAA
1501    ------------+---------+---------+---------+---------+---------+ 1560
        CATTGAAAATAATTAATCTCTTATTTGATTTAATGATTATATCTCTAGTCGCTAGAAGTT a     V   T   F   I   N   *   R   I   N   *   I   T   N   I   E   I   S   D   L   Q   -
b       *   L   L   L   I   R   E   *   T   K   L   L   I   *   R   S   A   I   F   N   -
c         N   F   Y   *   L   E   N   K   L   N   Y   *   Y   R   D   Q   R   S   S   I   -

TTGACGAAATAAAAGCTGAACTAAAGTTAGACAATAAAAAATACAAACCTTGGTCAAAAT
1561    ------------+---------+---------+---------+---------+---------+ 1620
        AACTGCTTTATTTTCGACTTGATTTCAATCTGTTATTTTTATGTTTGGAACCAGTTTTA a     L   T   K   *   K   L   N   *   S   *   T   I   K   N   T   N   L   G   Q   N   -
b       C   R   N   K   S   C   T   K   V   R   Q   *   K   I   Q   T   L   V   K   I   -
c         D   E   I   K   A   E   L   K   L   D   N   K   K   Y   K   P   W   S   K   Y   -

ATTGAGGAAGGAAAAGAAGACCAGTTAGCAAAAGAAAAAATAAGGCAATAAATAAAATGA
1621    ------------+---------+---------+---------+---------+---------+ 1680
        TAACTCCTTCCTTTTCTTCTGGTCAATCGTTTTCTTTTTATTCCGTTATTTATTTTACT a     I   E   E   G   K   E   D   Q   L   A   K   E   K   I   R   Q   *   I   K   C   -
b       L   R   K   E   K   K   T   S   *   Q   K   K   K   *   G   N   K   *   N   E   -
c         C   G   R   K   R   R   P   V   S   K   R   K   N   K   A   I   N   K   M   S   -

GTACAGAAGTGAAGAAATAAAAGATTTATTTTTTTCAATAATTTATTGAAAAGAGGGGTT
1681    ------------+---------+---------+---------+---------+---------+ 1740
        CATGTCTTCACTTCTTTATTTTCTAAATAAAAAAGTTATTAAATAACTTTTCTCCCCAA a     V   Q   K   C   R   N   K   R   F   I   F   F   N   N   L   L   K   R   G   V   -
b       Y   R   S   E   E   I   K   D   L   F   F   S   I   I   Y   C   K   E   G   F   -
c         T   E   V   K   K   *   K   I   Y   F   F   Q   *   F   I   E   K   R   G   F   -

TTGGGGTTTTGGGGTTTTGGGG
1741    ------------+---------+--- 1762
        AACCCCAAAACCCCAAAACCCC a     L   G   F   W   G   F   G   -
b       W   G   F   G   V   L   G   -
c         G   V   L   G   F   W   -
```

FIG. 35D

```
  2 EVDVQNQADNHGIHSALKTCEEIKEAKTLYSWIQKVIRCRNQSQSHYKDL  51
    |:::   |  :.::|:   :|    |.::|    ::. .  |  |..|.|.|
 19 ELELEMQENQNDIQVRVK....IDDPKQY..LVNVTAACLLQEGSYYQDK  62

52 EDIKIFAQTNIVATPRDYNEEDFKVIARKEVF.STGLMIELIDKCLVELL 100
    ::       ..::    : .|.|  ..|..  .|:  ..:|  |   ...:|..:
 63 DERRYIITKALL....EVAESDPEFICQLAVYIRNELYIRTTTNYIVAF. 107

101 SSSDVSDRQKLQCFGFQLKGNQLAKTHLLTALSTQKQYFFQDEWNQVRAM 150
               ..:   ..::  .|:    ..::   |:.||    :
108 ............CVVHKNTQPFIEKYFNKAVLLPNDLLEVCEFAQVLYI 144

151 IGNELFRHLYTKYLIFQRTSEGTLVQFCGNNVFDHLKVNDKFDKKQKGGA 200
    :::.. | :||           |  .:  :.::  ..|.... :::  ::
145 FDATEFKNLY............LDRILSQDIRKELTFRKCLQRCVRSKF 181

201 ADMNE...PRCCSTCKYNVKNEKDHFLNNINVPNWNNMKSRTRIFYCTHF 247
    .::||    .::|..:    . |...  ::|.. .|  ..|:.  |.:
182 SEFNEYQLGKYCTES..QRKKTMFRYLSVTNKQKWDQTKKK......... 220

248 NRNNQFFKKHEFVSNKNNISAMDRAQTIFTNIFRFNRIRKKLKDKVIEKI 297
    |.:  ...|  :.  ..::   |   .:|    :|:...  |  ||. |:.||
221 .RKENLLTKLQAIKESEDKSKRETG.....DIMNVEDAIKALKPAVMKKI 264

298 AYMLEKVKDFNFNYYLTKSCPLPENWRERKQKIENLINKTREEKSKYYEE 347
    | ...:|               :. | ...:|.| |.|   :.:
265 AKRQNAMK..........KHMKAPKIPNSTLESKYLTFKD            294

348 LFSYTTDNKCVTQFINEFFYNILPKDFLTGRNRKNFQKKVKKYVELNKHE 397
    |:..    ...         .|  .|.||.|.:  ..  :   .   ..:| .|
295 LIKFCHISEP.....KERVYKILGKKYPKTEEEYKAAFGDSASAPFN.PE 338

398 LIHKNLLLEKINTREISWMQVETSAKHFYYFDHENIYVLWKLLRWIFEDL 447
    |  |..:|  .|:|  .|:  ..:|..  .|  .| :||     ::| :
339 LAGKRMKIEISKTWENELSAKGNTAEVWDNLISSNQLPYMAMLRNLSN.. 386

448 VVSLIRCFFYVTEQQKSYSKTYYYRKNIWDVIMKMSIADLKKETLAEVQE 497
                                       |:|  :::.|
387 ................................ILKAGVSD.......... 394

498 KEVEEWKKSLGFAPGKLRLIPKKTTFRPIMTFNKKIVNSDRKTTKLTTNT 547
                                                    || :.
395 ..............................................TTHS 398

548 KLLNSHLMLKTLKNRMFKDPFGFAVFNYDDVMKKYEEFVCKWKQVGQPKL 597
      |                                    :|. |.|:..|
399 IVINK................................ICEPKAVENSKM 415

598 FFATMDIEKCYDSVNREKLSTFLKTTKLLSSDFWIMTAQILKRKNNIVID 647
    |     :.. .. :.||   |  |:..  :|..|     .:   :.:||     |:   |::
416 F..PLQFFSAIEAVN.EAVTKGFKAKK...RENMNLKGQIEAVKE..VVE 457

648 SKNFRKKEMKDYFRQKFQKIALEGGQYPTLFSVLENEQNDLNAKKTLIVE 697
    ..:  |||:|           .||..:   ..:...| |.  ...:  .. .|  :.
458 KTDEEKKDM..........ELEQTEEGEFVKVNEGIKQYINSIELAIK   496

698 AKQRNYFKKDNLLQPVINICQYNYINFNGKFYKQTKGIPQGLCVSSILSS 747
    .. :...      :::.        .    :    |.    |. ::.. |    .. :|:
497 IAVKNLDEIKGHTAIFSDVSGSMSTSMSGGAKKYGSVRTCLECALVLGL  546

748 FYYATLEESSLGFLRDESMNPENPNVNLLMRLTDDYLLITTQENNAVLFI 797
     :  .  |.||:   : ::...|     ..::..  :::    :
547 MVKQRCEKSSFYIFSSPSSQCNKCYLEVDL....................576
```

FIG. 36A

```
798  EKLINVSRENGFKFNMKK.LQTSFPLSPSKFAKYGMDSVEEQNIVQDYCD  846
        .::::: .|.|  ||..  .|:.:   ...: ::::|  .  ....|
577  .......PGDELRPSMQKLLQEKGKLGGG..TDFPYECIDEWTKNKTHVD  617

847  WIGISIDMKTLALMPNINLRIEGILCTLNLNMQTKKASMWLKKKLKSFLM  896
     |.|  ||.. .   .:||:| .:| .:           ||.|. :
618  NIVILSDMMIAEGYSDINVRGSSIVNSI..............KKYKDEVN  653

897  NNITHYFRKTITTEDFANKTLNKLFISGGYKYMQCAKEYKD.HFKKNLAM  945
     ||. :   .:. |:::         |::.  :.|:.: :: | ::|
654  PNIKIF...AVDLEGYG............KCLNLGDEFNENNYIKIFGM  687

946  SSMIDLEVSKIIYSVTRAFFKYLVCNIKDTIFGEEHYPDFFLSTLKHFIE  995
     |.|              :|:::  ... :.                :::|
688  SDSI...........LKFISAKQGGA...............NMVE     706

996  IFSTKKYIFNRVC  1008
     ::    |.: :.::..
707  VI..KNFALQKIG  717
```

FIG. 36B

```
132  LSTQKQYFFQDEWNQVRAMIGNEL.FRHLYTKYLIFQRTSE..GTLVQFC  178
     :|  ..|       ....| ||||  : :. .. ::..  |   |  | .
1    MSRRNQ.......KKPQAPIGNETNLDFVLQNLEVYKSQIEHYKTQQQQI  43

179  GNNVFDHLKVNDKFDKKQKGGAADMNEPRCCSTCKYNVKNEKDHFLNNIN  228
     :: :. ||..:: :.  ..|...| :|        | .|...:|...:|
44   KEEDLKLLKFKNQDQDGNSGNDDDDEE.........NNSNKQQELLRRVN  84

229  VPNWNNMKSRTRIFYCTHFNRNNQFFKKHEFVSNKNNISAMDRAQTIFTN  278
     :.... |::||   |:.| |:..  ... ..  .: |
85   ................QIKQQVQLIKK...VGSKVEKDLNLNEDENKKN  114

279  IFRFNRIRKKLKDKVIEKIAYMLEKVKDFNFNYYLTKSCPLPENWRERKQ  328
     : ...::.  ...|..  : | :::.. |...|.. . ::||| .
115  GLSEQQVKEEQLRTITEEQVKYQNLVFNMDYQLDLNESGGHRRHRRETDY  164

329  KIENLINKTREEKSKYYEELFSYTTDNKCVTQFINE.FFYNILPKDFLTG  377
     ..|.|::: .::::|              ..:|. :|:  |  : ||::.
165  DTEKWFEISHDQK..............NYVSIYANQKTSYCWWLKDYFNK  200

378  RNRKNFQKKVKKYVELNKHELIHKNLLLEKINTREISWMQVETSAKHFYY  427
     .| |.::. ..::.  .. |:. :  : :.|.  : |:   |:..
201  NNYDHLNVSINRLE..TEAEFYAFDDFSQTIKLTNNSYQTVNID......  242

428  FDHENIYVLWKLLRWI..FEDLVVSLIRCFFYVTEQQKSYSKTYYYRKNI  475
     .: :| ..:: |||:| :| : ||:: | .| .:.|.       ..|
243  VNFDNNLCILALLRFLLSLERFNILNIRSSY..TRNQYNFEKIGELLETI  290

476  WDVIMKMSIADLKKETLAEVQEKEVEEWKKSLGFAPGKLRLIPKKTTFRP  525
     :.|:.. .       .:| .:: ...:.|                | . |.
291  FAVVFSHR..........HLQGIHLQVPCEAFQYLVNSSSQISVKDSQLQ  330

526  IMTFNKKIVNSDRKTTKLTTNTKLLNSHLMLKTLKNRMFKDPFGFAVFNY  575
     : |...: | |.|: . |:|.. :|:.. .| .... .. . || |.
331  VYSFSTDLKLVD..TNKVQDYFKFLQEFPRLTHVSQQAIPVSATNAVENL  378
```

FIG. 37A

```
576  DDVMKKYEEFVCKWKQVGQPKLF......FATMDIEKCYDS..VNREK       615
      : .:||          :.| |.|           :. :.:| ...:  :.::|
379  NVLLKKVKH  ANLNLVSIPTQFNFDFYFVNLQHLKLEFGLEPNILTKQK    426

516  LSTFL......KTTKLLSSDFWIMTAQILKRKNNI..VIDSKNFRKKEMK    657
     |...|      |.|:|     |:. ||   ||  :   ... ||::...
427  LENLLLSIKQSKNLKFLRLNFYTYVAQETSRKQILKQATTIKNLKNNKNQ    476

558  DYFRQKFQKIALEGGQYPTLFSVLEN..EQNDLNAKKTLIVEAKQRNYFK    705
      . .      |:   | | |     |:|:...   ::|.| |
477  EETPETKDETPSESTSGMKFFDHLSELTELEDFSVN....LQATQEIY..    520

706  KDNLLQPVINICQYNYINFNGKFYKQTKGIPQGLCVSSILSSFYYATLEE    755
     | |  |         .|       :.  :  ...|    |.||:
521  .DSLHKLLIRSTNLKKFKLSYKYEMEKSKMDTFIDLKNI.....YETLNN    564

756  SSLGFLRDESMNPENPNVNLLMRLTDDYLLITTQENNAVLFIEKLINVSR    305
         |:  | |  .||: |    ||:       .:..::   ||.
565  .....LKRCSVNISNPHGNISYELTN........KDSTFYKFKLTLNQE    500

806  ENGFKFNMKKLQTSFPLSPSKFAKYGMDSVEEQNIVQDYCDWIGISIDMK    855
      |:..|    |..|.:.  | ||.: .|:|. :  :::...|..|: : ::.
601  LQHAKYTFK..QNEFQFNNVKSAKIESSSLESLEDIDSLCKSIASCKNLQ    648

856  TLALMPNINLRIEGILCTLNLMQT..KKASMWLKK..KLKSFLMNNITH     901
     .:.:      | ::|:. |:.... |:.. . :  ..:||  .|. .|.
649  NVNI.......IASLLYPNNIQKNPFNKPNLLFFKQFEQLKNLENVSINC    691

902  YFRKTI...TTEDFANKTLNKLFISGGYKYMQCAKEYKDHFKKNLAMSSM    948
     .: . |     |  :.... | ||   | ..:|:   :|.. ||.  .:...:
692  ILDQHILNSISEFLEKNKKIKAFILKRYYLLQYYLDYTKLFKTLQQLPEL    741

949  IDLEVSKIIYSVT..............RAFFKYLVCNIKDT..IFGEEHY    982
     :: ...  :       |            :||:. |.  ||:.  .:.  .:
742  NQVYINQQLEELTVSEVHKQVWENHQKAFYEPLCEFIKESSQTLQLIDF    791

983  PDFFLS   TLKHFIEIFSTKKY  IFNRVCMILKAKEAKLKSDQCQSLIQ    1028
     .: :|     .|    |:|..||   .|:          |    |  ..::.|.|:.
792  DQNTVSDDSIKKILESISESKYHHYLRLNPSQSSSLIKSENEEIQELLK    840
```

FIG. 37B

```
  4  DIDLDDIENLLPNTFNKYSSSCSDKKGCKTLKSGSKSPSLTIPK......    47
     ::. ..||.    :.::...|   |..  :||.|....  :||  .|.
617  NVKSAKIESSSSLESLEDIDSLCKSIASCKNLQNVNIIASLLYPNNIQKNP    666

48  .......LQKQLEFYFSDANLYNDSFLRKLVLKSGEQRVE....IETLLM    86
       :  ||:|  . . .|:  :::|    :|.|   .: :|     |...:::
667  FNKPNLLFFKQFEQLKNLENVSINCILDQHILNSISEFLEKNKKIKAFIL    716
```

FIG. 38

```
  1 MEMDIDLDDIENL.....LPNTFNKYSSSCSDKKGCKTLKSGSKSPS...  42
    |:|...||   ...|.. |:| |...:. ||| ..:
491 IELAIKIAVNKNLDEIKGHTAIFSDVSGSMSTSMSGGAKKYGSVRTCLEC  540

43 .LTIPKLQKQ......LEFYFSDANLYNDSFLRKLVLKSGEQRVEIETLL  85
    |.: : ||      : :: |... :|.::| .: |.::| |..::.||
541 ALVLGLMVKQRCEKSSFYIFSSPSSQCNKCYL.EVDLPGDELRPSMQKLL  589
```

*FIG. 39*

```
telomerase p43    LQKQLEFYFSDANLYNDSFLRKLVLKSGEQRVEIETLLM
human La          ICHQUEYYFGDFNLPRDKFLKEQI.KLDEGWVPLEIMIK
Xenopus LaA       ICEQIEYYFGDHNLPRDKFLKQQI.LLDDGWVPLETMIK
Drosophila La     ILRQVEYYFGDANLNRDKFLREQIGKNEDGWVPLSVLVT
S. c. Lhp1p       CLKQVEFYFSEFNFPYDRFLRTTAEK.NDGWVPISTIAT
```

*FIG. 41*

```
   1 aactcattta attactaatt taatcaacaa gattgataaa aagcagtaaa taaaacccaa
  61 tagatttaat ttagaaagta tcaattgaaa aatggaaatt gaaaacaact aagcacaata
 121 gccaaaagcc gaaaaattgt ggtgggaact tgaattagag atgcaagaaa accaaaatga
 181 tatataagtt agggttaaga ttgacgatcc taagcaatat ctcgtgaacg tcactgcagc
 241 atgtttgttg taggaaggta gttactacta agataaagat gaaagaagat atatcatcac
 301 taaagcactt cttgaggtgg ctgagtctga tcctgagttc atctgctagt ggcagtcta
 361 catccgtaat gaactttaca tcagaactac cactaactac attgtagcat tttgtgttgt
 421 ccacaagaat actcaaccat tcatcgaaaa gtacttcaac aaagcagtac ttttgcctaa
 481 tgacttactg gaagtctgtg aatttgcata ggttctctat atttttgatg caactgaatt
 541 caaaatttg tatcttgata ggatactttc ataagatatt cgtaaggaac tcactttccg
 601 taagtgttta caaagatgcg tcagaagcaa gttttctgaa ttcaacgaat actaacttgg
 661 taagtattgc actgaatcct aacgtaagaa aacaatgttc cgttacctct cagttaccaa
 721 caagtaaaag tgggattaaa ctaagaagaa gagaaaagag aatctcttaa ccaaacttta
 781 ggcaataaag gaatctgaag ataagtccaa gagagaaact ggagacataa tgaacgttga
 841 agatgcaatc aaggctttaa aaccagcagt tatgaagaaa atagccaaga gatagaatgc
 901 catgaagaaa cacatgaagg cacctaaaat tcctaactct accttggaat caaagtactt
 961 gaccttcaag gatctcatta agttctgcca tatttctgag cctaaagaaa gagtctataa
1021 gatccttggt aaaaaatacc ctaagaccga agaggaatac aaagcagcct tggtgattc
1081 tgcatctgca cccttcaatc ctgaattggc tggaaagcgt atgaagattg aaatctctaa
1141 aacatgggaa aatgaactca gtgcaaaagg caacactgct gaggtttggg ataatttaat
1201 ttcaagcaat taactcccat atatggccat gttacgtaac.ttgtctaaca tcttaaaagc
1261 cggtgtttca gatactacac actctattgt gatcaacaag atttgtgagc ccaaggccgt
1321 tgagaactcc aagatgttcc ctcttcaatt ctttagtgcc attgaagctg ttaatgaagc
1381 agttactaag ggattcaagg ccaagaagag agaaaatatg aatcttaaag gtcaaatcga
1441 agcagtaaag gaagttgtta aaaaaaccga tgaagagaag aaagtatatgg agttggagta
1501 aaccgaagaa ggagaatttg ttaaagtcaa cgaaggaatt ggcaagcaat acattaactc
1561 cattgaactt gcaatcaaga tagcagttaa caagaattta gatgaaatca aggacacac
1621 tgcaatcttc tctgatgttt ctggttctat gagtacctca atgtcaggtg gagccaagaa
1681 gtatggttcc gttcgtactt gtctcgagtg tgcattagtc cttggtttga tggtaaaata
1741 acgttgtgaa aagtcctcat tctacatctt cagttcacct agttctcaat gcaataagtg
1801 ttacttagaa gttgatctcc ctggagacga actccgtcct tctatgtaaa aacttttgca
1861 agagaaagga aaacttggtg gtggtactga tttcccctat gagtgcattg atgaatggac
1921 aaagaataaa actcacgtag acaatatcgt tattttgtct gatatgatga ttgcagaagg
1981 atattcagat atcaatgtta gaggcagttc cattgttaac agcatcaaaa agtacaagga
2041 tgaagtaaat cctaacatta aaatctttgc agttgactta gaaggttacg gaaagtgcct
2101 taatctaggt gatgagttca atgaaacaa ctacatcaag atattcggta tgagcgattc
2161 aatcttaaag ttcatttcag ccaagcaagg aggagcaaat atggtcgaag ttatcaaaaa
2221 cttttgccctt caaaaatag gacaaaagtg agtttcttga gattcttcta taacaaaaat
2281 ctcaccccac tttttgttt tattgcatag ccattatgaa atttaaatta ttatctattt
2341 atttaagtta cttacatagt ttatgtatcg cagtctatta gcctattcaa atgattctgc
2401 aagaacaaa aaagattaaa a
```

*FIG. 42*

```
                              Motif A                                        Motif B
                       h--hDh---h--h                              h---+-QG---SP
Consensus              GQPKLFFATMDIEKCYDSVNREKLSTFLKTTKLL-100-KFYKQTKGIPQGLCVSSILSSFYYATLEESSLGFL
telomerase p123        KNRNLHCTYDDYKKAFDSIPHSWLIQVLEIYKIN- 28-RQIAIKKGIYQGDSLSPLWFCLALNPLSHQLHNDR
Dong (LINE)            FGGSNWFREVDLKKCFDTISHDLIIKELKRYISD- 26-HVPVGPRVCVQGAPTSPALCNAVLLRLDRRLAGLA
al S.c. (groupII)      LKKKKSVTVLDVGDAYFSVPLDEDFRKYTAFTIP-  7-GIRYQYNVLPQGWKGSPAIFQSSMTKILEPFRKQN
HIV-RT                 VLPELYFMKFDVKSCYDSIPRMECMRILKDALKN- 68-KCYIREDGLFQGSSLSAPIVDLVYDDLLEFYSEFK
L8543.12

Motif C                           Motif D                      Motif E
                       h--YhDDhhh                         Gh-h--K                     h-hLGh-h
Consensus              -14-LMRLTDDYLLITTQENN- 0-AVLFIEKLINVSRENGFKFNMKKLQT-23-QDYCDWIGISI
telomerase p123        -16-HLIYMDDIKLYAKNDKE- 0-MKKLIDTTTIFSNDISMQFGLDKCKT-25-KCLYKYLGFQQ
Dong (LINE)            -55-YVRYADDILIGVLGSKN- 2-KIIKRDLNNFLNS.LGLTINEEKTLI- 4-ETPARFLGYNI
al S.c. (groupII)      - 4-IYQYMDDLYVGSHLEIG- 1-HRTKIEELRQHLLRWGLTTPDKKHQK- 0-EPPFLWMGYEL
HIV-RT                 - 8-ILKLADDFLIISTDQQQ.........VINIKKLAMGGFQKYNAKANR-41-IRSKSSKGIFR
L8543.12
```

FIG. 40

```
MEIENNQAQQPKAEKLWWELELEMQENQNDIQVRVKIDDPKQYL
VNVTAACLLQEGSYYQDKDERRYIITKALLEVAESDPEFICQLA
VYIRNELYIRTTTNYIVAFCVVHKNTQPFIEKYFNKAVLLPNDL
LEVCEFAQVLYIFDATEFKNLYLDRILSQDIRKELTFRKCLQRC
VRSKFSEFNEYQLGKYCTESQRKKTMFRYLSVTNKQKWDQTKKK
RKENLLTKLQAIKESEDKSKRETGDIMNVEDAIKALKPAVMKKI
AKRQNAMKKHMKAPKIPNSTLESKYLTFKDLIKFCHISEPKERV
YKILGKKYPKTEEEYKAAFGDSASAPFNPELAGKRMKIEISKTW
ENELSAKGNTAEVWDNLISSNQLPYMAMLRNLSNILKAGVSDTT
HSIVINKICEPKAVENSKMFPLQFFSAIEAVNEAVTKGFKAKKR
ENMNLKGQIEAVKEVVEKTDEEKKDMELEQTEEGEFVKVNEGIG
KQYINSIELAIKIAVNKNLDEIKGHTAIFSDVSGSMSTSMSGGA
KKYGSVRTCLECALVLGLMVKQRCEKSSFYIFSSPSSQCNKCYL
EVDLPGDELRPSMQKLLQEKGKLGGGTDFPYECIDEWTKNKTHV
DNIVILSDMMIAEGYSDINVRGSSIVNSIKKYKDEVNPNIKIFA
VDLEGYGKCLNLGDEFNENNYIKIFGMSDSILKFISAKQGGANM
VEVIKNFALQKIGQK
```

FIG. 43

```
MSRRNQKKPQAPIGNETNLDFVLQNLEVYKSQIEHYKTQQQQIK
EEDLKLLKFKNQDQDGNSGNDDDDEENNSNKQQELLRRVNQIKQ
QVQLIKKVGSKVEKDLNLNEDENKKNGLSEQQVKEEQLRTITEE
QVKYQNLVFNMDYQLDLNESGGHRRHRRETDYDTEKWFEISHDQ
KNYVSIYANQKTSYCWWLKDYFNKNNYDHLNVSINRLETEAEFY
AFDDFSQTIKLTNNSYQTVNIDVNFDNNLCILALLRFLLSLERF
NILNIRSSYTRNQYNFEKIGELLETIFAVVFSHRHLQGIHLQVP
CEAFQYLVNSSSQISVKDSQLQVYSFSTDLKLVDTNKVQDYFKF
LQEFPRLTHVSQQAIPVSATNAVENLNVLLKKVKHANLNLVSIP
TQFNFDFYFVNLQHLKLEFGLEPNILTKQKLENLLLSIKQSKNL
KFLRLNFYTYVAQETSRKQILKQATTIKNLKNNKNQEETPETKD
ETPSESTSGMKFFDHLSELTELEDFSVNLQATQEIYDSLHKLLI
RSTNLKKFKLSYKYEMEKSKMDTFIDLKNIYETLNNLKRCSVNI
SNPHGNISYELTNKDSTFYKFKLTLNQELQHAKYTFKQNEFQFN
NVKSAKIESSSLESLEDIDSLCKSIASCKNLQNVNIIASLLYPN
NIQKNPFNKPNLLFFKQFEQLKNLENVSINCILDQHILNSISEF
LEKNKKIKAFILKRYYLLQYYLDYTKLFKTLQQLPELNQVYINQ
QLEELTVSEVHKQVWENHKQKAFYEPLCEFIKESSQTLQLIDFD
QNTVSDDSIKKILESISESKYHHYLRLNPSQSSSLIKSENEEIQ
ELLKACDEKGVLVKAYYKFPLCLPTGTYYDYNSDRW
```

FIG. 45

```
MKILFEFIQDKLDIDLQTNSTYKENLKCGHFNGLDEILTTCFAL
PNSRKIALPCLPGDLSHKAVIDHCIIYLLTGELYNNVLTFGYKI
ARNEDVNNSLFCHSANVNVTLLKGAAWKMFHSLVGTYAFVDLLI
NYTVIQFNGQFFTQIVGNRCNEPHLPPKWVQRSSSSSATAAQIK
QLTEPVTNKQFLHKLNINSSSFFPYSKILPSSSSIKKLTDLREA
IFPTNLVKIPQRLKVRINLTLQKLLKRHKRLNYVSILNSICPPL
EGTVLDLSHLSRQSPKERVLKFIIVILQKLLPQEMFGSKKNKGK
IIKNLNLLLSLPLNGYLPFDSLLKKLRLKDFRWLFISDIWFTKH
NFENLNQLAICFISWLFRQLIPKIIQTFFYCTEISSTVTIVYFR
HDTWNKLITPFIVEYFKTYLVENNVCRNHNSYTLSNFNHSKMRI
IPKKSNNEFRIIAIPCRGADEEEFTIYKENHKNAIQPTQKILEY
LRNKRPTSFTKIYSPTQIADRIKEFKQRLLKKFNNVLPELYFMK
FDVKSCYDSIPRMECMRILKDALKNENGFFVRSQYFFNTNTGVL
KLFNVVNASRVPKPYELYIDNVRTVHLSNQDVINVVEMEIFKTA
LWVEDKCYIREDGLFQGSSLSAPIVDLVYDDLLEFYSEFKASPS
QDTLILKLADDFLIISTDQQQVINIKKLAMGGFQKYNAKANRDK
ILAVSSQSDDDTVIQFCAMHIFVKELEVWKHSSTMNNFHIRSKS
SKGIFRSLIALFNTRISYKTIDTNLNSTNTVLMQIDHVVKNISE
CYKSAFKDLSINVTQNMQFHSFLQRIIEMTVSGCPITKCDPLIE
YEVRFTILNGFLESLSSNTSKFKDNIILLRKEIQHLQAYIYIYI
HIVN
```

FIG. 46

```
   1 tcaatactat taattaataa ataaaaaaaa gcaaactaca aagaaaatgt caaggcgtaa
  61 ctaaaaaaag ccataggctc ctataggcaa tgaaacaaat cttgattttg tattacaaaa
 121 tctagaagtt tacaaaagcc agattgagca ttataagacc tagtagtaat agatcaaaga
 181 ggaggatctc aagcttttaa agttcaaaaa ttaagattag gatggaaact ctggcaacga
 241 tgatgatgat gaagaaaaca actcaaataa ataataagaa ttattaagga gagtcaatta
 301 gattaagtag caagtttaat tgataaaaaa agttggttct aaggtagaga aagatttgaa
 361 tttgaacgaa gatgaaaaca aaaagaatgg actttctgaa tagcaagtga aagaagagta
 421 attaagaacg attactgaag aataggttaa gtattaaaat ttagtattta acatggacta
 481 ccagttagat ttaaatgaga gtggtggcca tagaagacac agaagagaaa cagattatga
 541 tactgaaaaa tggtttgaaa tatctcatga ccaaaaaaat tatgtatcaa tttacgccaa
 601 ctaaaagaca tcatattgtt ggtggcttaa agattatttt aataaaaaca attatgatca
 661 tcttaatgta agcattaaca gactagaaac tgaagccgaa ttctatgcct ttgatgattt
 721 ttcacaaaca atcaaactta ctaataattc ttactagact gttaacatag acgttaattt
 781 tgataataat ctctgtatac tcgcattgct tagattttta ttatcactag aaagattcaa
 841 tattttgaat ataagatctt cttatacaag aaattaatat aatttttgaga aaattggtga
 901 gctacttgaa actatcttcg cagttgtctt ttctcatcgc cacttacaag gcattcattt
 961 acaagttcct tgcgaagcgt tctaatattt agttaactcc tcatcataaa ttagcgttaa
1021 agatagctaa ttataggtat actctttctc tacagactta aaattagttg acactaacaa
1081 agtccaagat tattttaagt tcttataaga attccctcgt ttgactcatg taagctagta
1141 ggctatccca gttagtgcta ctaacgctgt agagaacctc aatgttttac ttaaaaaggt
1201 caagcatgct aatcttaatt tagtttctat ccctacctaa ttcaattttg atttctactt
1261 tgttaattta taacatttga aattagagtt tggattagaa ccaaatattt tgacaaaaca
1321 aaagcttgaa aatctacttt tgagtataaa ataatcaaaa aatcttaaat ttttaagatt
1381 aaacttttac acctacgttg cttaagaaac ctccagaaaa cagatattaa aacaagctac
1441 aacaatcaaa aatctcaaaa acaataaaaa tcaagaagaa actcctgaaa ctaaagatga
1501 aactccaagc gaaagcacaa gtggtatgaa attttttgat catctttctg aattaaccga
1561 gcttgaagat ttcagcgtta acttgtaagc tacccaagaa atttatgata gcttgcacaa
1621 acttttgatt agatcaacaa atttaaagaa gttcaaatta agttacaaat atgaaatgga
1681 aaagagtaaa atggatacat tcatagatct taagaatatt tatgaaacct aaacaatct
1741 taaaagatgc tctgttaata tatcaaatcc tcatggaaac atttcttatg aactgacaaa
1801 taaagattct acttttata aatttaagct gaccttaaac taagaattat aacacgctaa
1861 gtatactttt aagtagaacg aattttaatt taataacgtt aaaagtgcaa aaattgaatc
1921 ttcctcatta gaaagcttag aagatattga tagtctttgc aaatctattg cttcttgtaa
1981 aaatttacaa aatgttaata ttatcgccag tttgctctat cccaacaata tttagaaaaa
2041 tcctttcaat aagcccaatc ttctattttt caagcaattt gaataattga aaaatttgga
2101 aaatgtatct atcaactgta ttcttgatca gcatatactt aattctattt cagaattctt
2161 agaaaagaat aaaaaaataa aagcattcat tttgaaaaga tattatttat tacaatatta
2221 tcttgattat actaaattat ttaaaacact tcaatagtta cctgaattaa attaagttta
2281 cattaattag caattagaag aattgactgt gagtgaagta cataagtaag tatgggaaaa
2341 ccacaagcaa aaagctttct atgaaccatt atgtgagttt atcaaagaat catcctaaac
2401 cctttagcta atagattttg accaaaacac tgtaagtgat gactctatta aaaagatttt
2461 agaatctata tctgagtcta agtatcatca ttatttgaga ttgaacccta gttaatctag
2521 cagtttaatt aaatctgaaa acgaagaaat ttaagaactt ctcaaagctt gcgacgaaaa
2581 aggtgtttta gtaaagcat actataaatt ccctctatgt ttaccaactg gtacttatta
2641 cgattacaat tcagatagat ggtgattaat taaatattag tttaaataaa tattaaatat
2701 tgaatatttc tttgcttatt atttgaataa tacatacaat agtcattttt agtgttttga
2761 atatatttta gttatttaat tcattatttt aagtaaataa ttatttttca atcatttttt
2821 aaaaaatcg
```

FIG. 44

Oxytricha   LCVSYILSSFYYANLEENALQFLRKESMDPEKPETNLLMRLT
Euplotes    LCVSSILSSFYYATLEESSLGFLRDESMNPENPNVNLLMRLT

FIG. 47

ATTTATACTCATGAAAATCTTATTCGAGTTCATTCAAGACAAGCTTGACATTGATCTACA
GACCAACAGTACTTACAAAGAAATTTAAAATGTGGTCACTTCAATGGCCTCGATGAAAT
TCTAACTACGTGTTTCGCACTACCAAATTCAAGAAAAATAGCATTACCATGCCTTCCTGG
TGACTTAAGCCACAAAGCAGTCATTGATCACTGCATCATTTACCTGTTGACGGGCGAATT
ATACAACAACGTACTAACATTTGGCTATAAAATAGCTAGAAATGAAGATGTCAACAATAG
TCTTTTTTGCCATTCTGCAAATGTTAACGTTACGTTACTGAAAGGCGCTGCTTGGAAAAT
GTTCCACAGTTTGGTCGGTACATACGCATTCGTTGATTTATTGATCAATTATACAGTAAT
TCAATTTAATGGGCAGTTTTTCACTCAAATCGTGGGTAACAGATGTAACGAACCTCATCT
GCCGCCCAAATGGGTCCAACGATCATCCTCATCATCCGCAACTGCTGCGCAAATCAAACA
ACTTACAGAACCAGTGACAAATAAACAATTCTTACACAAGCTCAATATAAATTCCTCTTC
TTTTTTTCCTTATAGCAAGATCCTTCCTTCATCATCATCTATCAAAAGCTAACTGACTT
GAGAGAAGCTATTTTTCCCACAAATTTGGTTAAAATTCCTCAGAGACTAAAGGTACGAAT
TAATTTGACGCTGCAAAAGCTATTAAAGAGACATAAGCGTTTGAATTACGTTTCTATTTT
GAATAGTATTTGCCCACCATTGGAAGGGACCGTATTGGACTTGTCGCATTTGAGTAGGCA
ATCACCAAAGGAACGAGTCTTGAAATTTATCATTGTTATTTACAGAAGTTATTACCCCA
AGAAATGTTTGGCTCAAAGAAAAATAAAGGAAAAATTATCAAGAATCTAAATCTTTTATT
AAGTTTACCCTTAAATGGCTATTTACCATTTGATAGTTTGTTGAAAAAGTTAAGATTAAA
GGATTTTCGGTGGTTGTTCATTTCTGATATTTGGTTCACCAAGCACAATTTTGAAAACTT
GAATCAATTGGCGATTTGTTTCATTTCCTGGCTATTTAGACAACTAATTCCCAAAATTAT
ACAGACTTTTTTTTACTGCACCGAAATATCTTCTACAGTGACAATTGTTTACTTTAGACA
TGATACTTGGAATAAACTTATCACCCCTTTTATCGTAGAATATTTTAAGACGTACTTAGT
CGAAAACAACGTATGTAGAAACCATAATAGTTACACGTTGTCCAATTTCAATCATAGCAA
AATGAGGATTATACCAAAAAAAGTAATAATGAGTTCAGGATTATTGCCATCCCATGCAG
AGGGGCAGACGAAGAAGAATTCACAATTTATAAGGAGAATCACAAAAATGCTATCCAGCC
CACTCAAAAAATTTTAGAATACCTAAGAAACAAAAGGCCGACTAGTTTTACTAAAATATA
TTCTCCAACGCAAATAGCTGACCGTATCAAAGAATTTAAGCAGAGACTTTTAAAGAAATT
TAATAATGTCTTACCAGAGCTTTATTTCATGAAATTTGATGTCAAATCTTGCTATGATTC
CATACCAAGGATGGAATGTATGAGGATACTCAAGGATGCGCTAAAAAATGAAAATGGGTT
TTTCGTTAGATCTCAATATTTCTTCAATACCAATACAGGTGTATTGAAGTTATTTAATGT
TGTTAACGCTAGCAGAGTACCAAAACCTTATGAGCTATACATAGATAATGTGAGGACGGT
TCATTTATCAAATCAGGATGTTATAAACGTTGTAGAGATGGAAATATTTAAAACAGCTTT
GTGGGTTGAAGATAAGTGCTACATTAGAGAAGATGGTCTTTTTCAGGGCTCTAGTTTATC
TGCTCCGATCGTTGATTTGGTGTATGACGATCTTCTGGAGTTTTATAGCGAGTTTAAAGC
CAGTCCTAGCCAGGACACATTAATTTTAAAACTGGCTGACGATTTCCTTATAATATCAAC
AGACCAACAGCAAGTGATCAATATCAAAAAGCTTGCCATGGGCGGATTTCAAAAATATAA
TGCGAAAGCCAATAGAGACAAAATTTTAGCCGTAAGCTCCCAATCAGATGATGATACGGT
TATTCAATTTTGTGCAATGCACATATTTGTTAAAGAATTGGAAGTTTGGAAACATTCAAG
CACAATGAATAATTTCCATATCCGTTCGAAATCTAGTAAAGGGATATTTCGAAGTTTAAT
AGCGCTGTTTAACACTAGAATCTCTTATAAAACAATTGACACAAATTTAAATTCAACAAA
CACCGTTCTCATGCAAATTGATCATGTTGTAAAGAACATTTCGGAATGTTATAAATCTGC
TTTTAAGGATCTATCAATTAATGTTACGCAAAATATGCAATTTCATTCGTTCTTACAACG
CATCATTGAAATGACAGTCAGCGGTTGTCCAATTACGAAATGTGATCCTTTAATCGAGTA
TGAGGTACGATTCACCATATTGAATGGATTTTGGAAAGCCTATCTTCAAACACATCAAA
ATTTAAAGATAATATCATTCTTTTGAGAAAGGAAATTCAACACTTGCAAGC

FIG. 48

AKFLHWLMSVYVVELLRSFFYVTETTFQKNRLFFYRKSVWSKLQSIGIRQHLKR
VQLRDVSEAEVRQHREARPALLTSRLRFIPKPDGLRPIVNMDYVVGARTFRREK
RAERLTSRVKALFSVLNYERA

FIG. 49

GCCAAGTTCCTGCACTGGCTGATGAGTGTGTACGTCGTCGAGCTGCTCAGGTC
TTTCTTTTATGTCACGGAGACCACGTTTCAAAAGAACAGGCTCTTTTTCTACC
GGAAGAGTGTCTGGAGCAAGTTGCAAAGCATTGGAATCAGACAGCACTTGAAG
AGGGTGCAGCTGCGGGACGTGTCGGAAGCAGAGGTCAGGCAGCATCGGGAAGC
CAGGCCCGCCCTGCTGACGTCCAGACTCCGCTTCATCCCCAAGCCTGACGGGC
TGCGGCCGATTGTGAACATGGACTACGTCGTGGGAGCCAGAACGTTCCGCAGA
GAAAAGAGGGCCGAGCGTCTCACCTCGAGGGTGAAGGCACTGTTCAGCGTGCT
CAACTACGAGCGGGCGCG

FIG. 50

MTEHHTPKSRILRFLENQYVYLCTLNDYVQLVLRGSPASSYSNICERLRSDVQTSFSIFLHSTVVGF
DSKPDEGVQFSSPKCSQSELIANVVKQMFDESFERRRNLLMKGFSMNHEDFRAMHVNGVQNDLVSTF
PNYLISILESKNWQLLLEIIGSDAMHYLLSKGSIFEALPNDNYLQISGIPLFKNNVFEETVSKKRKR
TIETSITQNKSARKEVSWNSISISRFSIFYRSSYKKFKQDLYFNLHSICDRNTVHMWLQWIFPRQFG
LINAFQVKQLHKVIPLVSQSTVVPKRLLKVYPLIEQTAKRLHRISLSKVYNHYCPYIDTHDDEKILS
YSLKPNQVFAFLRSILVRVFPKLIWGNQRIFEIILKDLETFLKLSRYESFSLHYLMSNIKISEIEWL
VLGKRSNAKMCLSDFEKRKQIFAEFIYWLYNSFIIPILQSFFYITESSDLRNRTVYFRKDIWKLLCR
PFITSMKMEAFEKINENNVRMDTQKTTLPPAVIRLLPKKNTFRLITNLRKRFLIKMGSNKKMLVSTN
QTLRPVASILKHLINEESSGIPFNLEVYMKLLTFKKDLLKHRMFGRKKYFVRIDIKSCYDRIKQDLM
FRIVKKKLKDPEFVIRKYATIHATSDRATKNFVSEAFSYFDMVPFEKVVQLLSMKTSDTLFVDFVDY
WTKSSSEIFKMLKEHLSGHIVKIGNSQYLQKVGIPQGSILSSFLCHFYMEDLIDEYLSFTKKKGSVL
LRVVDDFLFITVNKKDAKKFLNLSLRGFEKHNFSTSLEKTVINFENSNGIINNTFFNESKKRMPFFG
FSVNMRSLDTLLACPKIDEALFNSTSVELTKHMGKSFFYKILRSSLASFAQVFIDITHNSKFNSCCN
IYRLGYSMCMRAQAYLKRMKDIFIPQRMFITDLLNVIGRKIWKKLAEILGYTSRRFLSSAEVKWLFC
LGMRDGLKPSFKYHPCFEQLIYQFQSLTDLIKPLRPVLRQVLFLHRRIAD

FIG. 51

```
ggtaccgattacttccttcttcataagctaattgcttcctgaacgctcctaaatctctgaaatattttacaaga
actcaataacaataccaagtcaaattccaatatgaagtgttattgatcgataatatttctatttatcggtcgtta
ccaagtataaggacaaaagaacaactcccttcctcccctaaagactttttacttattactttcaaatatattcg
ggttcgcttactttaatcgtgtgactgtttagctgctactcctagcaaccgcgtgtttctacccgtcattggatat
agctcttggagtagctcacagaaatcctttacaaatctctgatgagactatattagattcattacagtcgtcatattc
ttaacatggagccttacacttagatgagtcacgtcgcatgatgaggtattggtatcatccaacgttgcctgaaaag
gttgataattattgcaaaatcatgtctagtgtcgtccttagtggtggtaatccgcgaaagtttttgatgctgcacacgtctagcatg
atgagatattcaaaaattctatccactacaactccttaacgcggtttatttctctatttctcatgttgtt
ccaaatatgtatcatctcgtattaggctttttcgttttactcctgaatcgtactctactgtagttattagtttaaa
ataatctaaattagttcgttataagttgatagtagaagattgtgattctactgagaaagaaagattgttattagttcggtc
gatactttgcaaaacattattagctatcattatatagagaaatcctataatattaataatattaatcaatatttcgggtc
actattttatttaaacgttatgatcagtaggacacttgcatatatatagttatgcttacttgtaactgcAT
GACCGAACACCATACCCCAAAGCTGTTTGAGAGGGTCGCCGGACAAGCTCGACTGTAGTCGGCTGTATAGAGAATCAATATATGCGAACGCTTGAGAAGCGATGTACAAACG
TCCTTTCTATTTTTCTCATTCAGAGgtatatataTTTGtttgattttctcattcgggatagctaagcCAGATGAAGGTGTTCAATTTCTCTCCAAA
ATGCTCACAGTCAGAGgtataatatatTTGTttgattttctcattcgggatagctaagcCAGATGAAGGTGTTCAATTTCTCTCCAAA
GAATGTTGTAAAACAGATGTCGATGAAAGTTTTGAGCGTCGAAGGAATCTACTGATGAAAGGGTTTCCATGtaagt
attctaattgtgaaatattttacctgcaattactgtttcaaagagattgtatttaaccgataaagAATCATGAAGATTTC
GAGCCATGCATGTAAACGGAGTACAAAATGATCTCGTTTCTACTTTCTTACCTTTATATCTATACTTGAGTCAAAA
AATTGGCAACTTTGTTAGAAATgtaaataccggttaagatgttgcgcacttgaacaagactgacaagtagTATCGG
CAGTGATGCCATGCATTACTTATTATCCAAAGGAAGTATTTTGAGGCTCTTCCAAATGACAATTACCTTCAGATTTCTG
GCATACCACTTTTTAAAAATAATGTGTTTGAGGAAACTGTCAAAAAAAGAAGAGCGAACCATTGAAACATCCATTACT
CAAAATAAAAGCGCCCGCAAGtaactaatactgttatcctcataataattttagATCTATATTTTAACTTACACTCTATTT
TAAGAAGTTTAAGCAAGACACAGTACACATGGCTTCAATGATTTTCCAAGGCAATTTGGACTTATAAACGCATTTCAAGTGAAG
GTGATCGGAACACAGTACACATGGCTTCAATGATTTTCCAAGGCAATTTGGACTTATAAACGCATTTCAAGTGAAG
CAATTGCACAAAGTGATTCCACTGGTATCACAGAGTACAGTTGTGCCAAACGTCTCCTAAGGTATACCCTTTAATTGA
ACAAACAGCAAAGCGACTCCATCGTATTCTCTATCAAGTTACAACCATTATGCCCATATATTGCACACCACGATG
ATGAAAAATCCTTAGTTATTCCTTAAAGCCGAACCAGGTGTGTTTGCGTTTCTTCGATCATTCTTGTTCGAGTGTTTCCT
AATTAATCTGGGGTAACCAAAGGATATTTGAGATAATTGAGATACGAGTCTTTTAGTTTACATTATTTAATGAGTAACATAAGgtaa
accagACCTCGAAACTTTCTGAACATTTCTTACCATTAATAACAATCAGATTTCAGAAATTGAATGGCTAGTCCTTGGAAAAGGTCAAATGCG
tatgccaaatttttaccattaataacaatcagATTTCAGAAATTGAATGGCTAGTCCTTGGAAAAGGTCAAATGCG
AAAATGTGCTTAAGTGATTTGAGAAACGCAAGCAAATATTTGCGAATTCATCTACTGGCTATACAATTCGTTTATAAT
ACCTATTTACAATCTTTTTTTTATATCACTCAAGTCAATCAAGTGATTTACGAAATCGAACTGTTTATTTAGAAAGATATTT
GGAAACTCTTGTCGCGACCCTTTATTACTTTCAGAACAATGTTAGCATCAATGAAAATGAAGCGTTGAAAAATAAACGAGtatttaaagtatt
tttgcaaaagctaatattcagAACAATGTTAGGATACTCAGAAAACTACTTTGCCTCCAGCAGTTATTCGTC
TATTCCTAAGAAGATACCTTTCGTCTAATCTATtatagcagATGGTTCAAACAAAAAATGTTAGTACGACGAACCAAACTTTACG
caatgtacttacttcctactctattattagcagATGGTTCAAACAAAAAATGTTAGTACGACGAACCAAACTTTACG
ACCTGTGGCATCGATACTGAAACATTTAATCAATGAAGAAGTAGTGGTATTCCATTTAACTTGGAGGTTTACATGAAGC
```

```
EST2 pep            FFYCTEISST VTIVYFRHDT WN----KLIT P-----FIVE YFK-TYLVEN   40
Euplotes pep        FFYVTEQQKS YSKTYYYRKN IWDVI-MKMS IAD----LKK ETLA--EVQE   43
Trans of tetrahymen -----KHKE GSQIFYYRKP IWKLVSKLTI VKVRIQFSEK NKQMKNNFYQ     44

Consensus           ........  FFY.TE..K. .S..YYYRK. IW.....KL. .......F..K  ....V..    50

EST2 pep            NVCRNHNSY- --------- --------- TLSNFNHSKM RHITPKKSNNE FRITAIPCRG  79
Euplotes pep        KEVEEWKKSL --------- --------- ---GFAPGKG RLIPKKTT-- FRPIMTFNKK  78
Trans of tetrahymen KIQLEEENLE KVEEKLIPED SFQKYPQGKL RHIPKKGS-- FRPIMTFLRK             92

Consensus           K...E....  .........  .........  ....F..GKL RHIPKK.... FRPIMTF.RK  100

EST2 pep            ADEEEFTIYK ENHKNAIQPT QKILEYLRNK RPTSFTKIYS PTQIADRIKE              129
Euplotes pep        IVNSDRKTTK LTTNTKLLNS HLMLKTLKN- ------RMFK -DPFGFAVFN              120
Trans of tetrahymen DKQKNIK--- LNLNQILMDS QLVFRNLKD- ------ML-G -QKIGYSVFD              130

Consensus           ......K..K LN.N..L..S QL.L..LKN. ..........  ...IG..VF.              150

EST2 pep            FKQRLLKKFN NVL------ -PELYFMKFD VKSCYD                              157
Euplotes pep        YD-DVMKKYE EFVCKWKQVH CPKLFFATMD IEKCYD                              155
Trans of tetrahymen NK-QISEKFA QFIEKWKNKG RPCLYYVTL-                                    158

Consensus           .K....KKF. .F..KWK..G .P.LYF.T.D  ...CYD                             186
```

*FIG. 53*

```
S-1: FFY VTE TTF QKN RLF FYR KSV WSK
S-2: RQH LKR VQL RDV SEA EVR QHR EA
S-3: ART FRR EKR AER LTS RVK ALF SVL NYE

A-1: AKF LHW LMS VYV VEL LRS FFY VTE TTF Q
A-2: LFF YRK SVW SKL QSI GIR QHL KRV QLR DVS
A-3: PAL LTS RLR FIP KPD GLR PIV NMD YVV
```

FIG. 54

```
Poly 4
              t       t         c
         t a     a g   c c   t c g
    5'- cag acc aaa gga att cca taa gg -3'
         Q   T   K   G   I   P   Q   G

4(B')

5(C')

D   D   Y   L   L   I   T
    3'- ctg ctg atg gag gag tag tgg -5'
         a   a   a a a a   a   a
                 t   t   t   t
                         c   c
                              Poly 1
```

FIG. 56

```
Ot                  LCVSYILSSFYYANLEENALQFLRKESMDPEKPETNLLMRLT
Ea_p123     KGIPQGLCVSSILSSFYYATLEESSLGFLRDESMNPENPNVNLLMRLTDDYLLIT
Sp_M2             SILSSFLCHFYMEDLIDEYLSFTKKK------GSVLLRVV
Sc_p103     DGLFQGSSLSAPIVDLVYDDLLEFYSEFKASPS------QDTLILKLADDPLIIS
                          *               *          .    ......

Q   K   V   G   I   P   Q   G
  caa aaa gtt ggt atc cct cag gg.......        <----Actual Genomic Sequence.

Poly 4
      t       t       c
  t   a   g   c   c   t c g
  cag acc aaa gga att cca taa gg ----> ag acc aaa gga att cca tca ggC TCA ATT CTG TCA TCT TTT TTG TGT CAT TTC TAT ATG
  tc tgg ttt cct taa ggt agt CCG AGT TAA GAC AGT AGA AAA AAC ACA GTA AAG ATA TAC
   K   G   I   P   S   G   S   I   L   S   S   F   L   C   H   F   Y   M
```

FIG. 58A

```
GAA GAT TTG ATT GAT GAA TAC CTA TCG TTT ACG AAA AAG AAA GGA TCA GTG TTG TTA CGA
CTT CTA AAC CTA CTT ATG GAT AGC TTC TTT AAA TGC CAC AGT CAC AAC AAT GCT
 E   D   L   I   D   E   Y   L   S   F   T   K   K   K   G   S   V   L   L   R

GTA GTC gac gac tac ctc ctc atc acc                                                    
CAT CAG ctg ctg atg gag gag tag tgg                                                    
        a   a   a   a   a   t   t                                                      
                    t   t   c   c                                                      
                        c   c                                                          
 V   V   D   D   Y   L   L   I   T                          <---- Poly 1 ctg ctg atg gag gag tag tgg                                                    
            a   a   a   a   t   t                                                      
                    t   c   c                                                          
                        c ....gac gat ttc ctc ttt ata aca......    <---Actual Genomic Sequence
     D   D   F   L   F   I   T

FIG. 58B
```

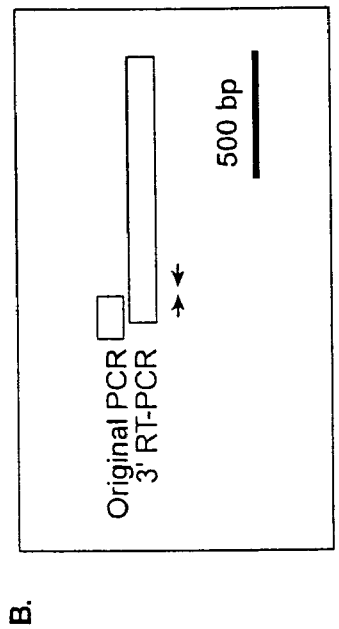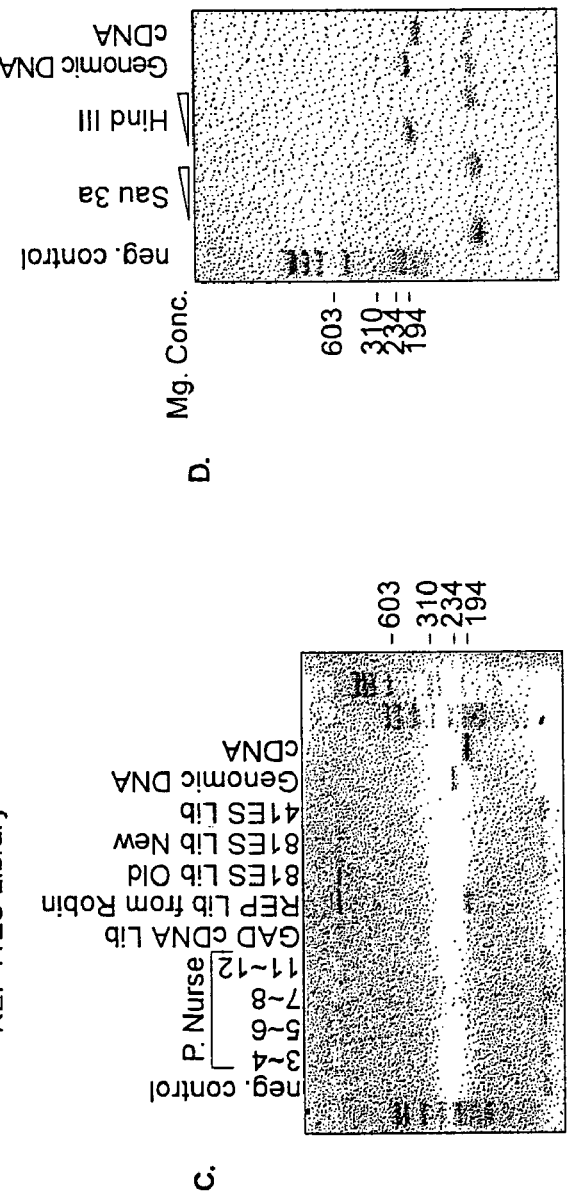
FIG. 60

```
                            Motif 0
S.p. Tez1p (429)..WLYNSFIIPILQSFFYITESSDLRNRTVYFRKDIW ...(35)...
S.c. Est2p (366)..WLFRQLIPKIIQTFFYCTEISSTVT-IVYFRHDTW ...(35)...
E.a. p123  (441)..WIFEDLVVSLIRCFFYVTEQQKSYSKTYYRKNIW ...(35)...
                  *          ***  **                    *

Motif 1      Motif 2    K
                     p hh h K         hR h     R
S.p. Tez1p         AVIRLLPKK--NTFRLITN-LRKRF    ...(61)...
S.c. Est2p         SKMRIIPKKSNNEFRIIAIPCRGAD    ...(62)...
E.a. p123          GKLRLIPKK--TTFRPIMTFNKKIV    ...(61)...
                      * ***          *

Motif 3(A)   AF
                    h hDh   GY  h
S.p. Tez1p        KKYFVRIDIKSCYDRIKQDLMFRIVK    ....(89)....
S.c. Est2p        ELYFMKFDVKSCYDSIPRMECMRILK    ....(75)....
E.a. p123         KLFFATMDIEKCYDSVNREKLSTFLK    ...(107)....
                    *         ***

Motif 4(B')
                    hPQG    pP hh   h
S.p. Tez1p        YLQKVGIPQGSILSSFLCHFYMEDLIDEYLSF ...(6)....
S.c. Est2p        YIREDGLFQGSSLSAPIVDLVYDDLLEFYSEF ...(8)....
E.a. p123         YKQTKGIPQGLCVSSILSSFYYATLEESSLGF ..(14)....
                     *   *                    *

Y Motif 5(C)                                   Motif 6(D)
                           h  F  DDhhh                              Gh h  cK   h
S.p. Tez1p        VLLRVVDDFLFITVNKKDAKKFLNLSRGFEKHNFSTSLEKTVINFENS .(205)
S.c. Est2p        LILKLADDFLIISTDQQQVINIKKLAMGGFQKYNAKANRDKILAVSSQS .(173)
E.a. p123         LLMRLTDDYLLITTQENNAVLFIEKLINVSRENGFKFNMKKLQTSFPLS .(209)
                       *                                              *
```

| | | |
|---|---|---|
| Sp_Tip1p | 1 | - - - - - - - - - - - - - - - - - - - M T E H H T P K S R I L R F L E N Q Y V Y L C T | 24 |
| Sc_Est2p | 1 | - - - - - - - - - - - - - - - - - - - - - - - - - - M K I L F E F | 7 |
| Ea_p123 | 1 | M E V D V D N Q A D N H G I H S A L K T C E E I K E A K T L Y S W | 33 |

| | | |
|---|---|---|
| Sp_Tip1p | 25 | L N D Y V Q L V L R G S P A S S Y S N I C E R L R S D V Q T S F S | 57 |
| Sc_Est2p | 8 | I Q D K L D I D L Q T N - - S T Y K - - - E N L K C G H F N G L D | 35 |
| Ea_p123 | 34 | L Q K V I R C R N Q S Q - - S H Y K - - - D L E D I K I F A Q T N | 61 |

| | | |
|---|---|---|
| Sp_Tip1p | 58 | I F L H S T V V G F D S K P D E G V Q F S S P K C S Q S E L I A N | 90 |
| Sc_Est2p | 36 | E I L T T C F A L P N S R - K I A L P C L P G D L S H K A V I D H | 67 |
| Ea_p123 | 62 | I V A T P R D Y N E E D F K V L A R K E V F S T G L M I E L I D K | 94 |

| | | |
|---|---|---|
| Sp_Tip1p | 91 | V V K Q M F D E S F E R R R - N L L M K G F S M N H E D F R A M H | 122 |
| Sc_Est2p | 68 | C I Y L L T G E L Y N - - - N V L T F G Y K I A R N E D - - - - | 93 |
| Ea_p123 | 95 | C L V E L L S S S D V S D R Q K L Q C F G F Q L K G N Q - - - - | 122 |

| | | |
|---|---|---|
| Sp_Tip1p | 123 | V N G V Q N D L V S T F P N Y L I S I L E S K N W Q L L E I L G | 155 |
| Sc_Est2p | 94 | - - - V N N S L F C H S A N V N V T L L K G A A W K M F H S L V G | 123 |
| Ea_p123 | 123 | - - - L A K T H L L T A L S T Q K Q Y F F Q D E W N Q V R A M I G | 152 |

| | | |
|---|---|---|
| Sp_Tip1p | 156 | S D A M H Y L L S K G S L F E A L P N D N Y L Q I S G L P L F K N | 188 |
| Sc_Est2p | 124 | T Y A F V D L L I N Y T V I Q F N - G Q F F T Q I V G N R C N E P | 155 |
| Ea_p123 | 153 | N E L F R H L Y T K Y L I F Q R T S E G T L V Q F C G N N V E D H | 185 |

| | | |
|---|---|---|
| Sp_Tip1p | 189 | N V F E E T V S K K R K R T I E T S I T Q N - - - K S A R K E V S | 218 |
| Sc_Est2p | 156 | H L P P K W V Q - - R S S S S S A T A A Q I - - - K Q L T E P V T | 183 |
| Ea_p123 | 186 | L K V N D K F D K - K Q K G G A A D M N E P R C C S T C K Y N V K | 217 |

```
              219                                                                              251
Sp_Tip1p      WNSISISRFSIFYRSSY KKFKQDLYFNLHSICD
Sc_Est2p      184 N- - - - - - - - - - - - - KQFLHKLNINSSFFP 200
Ea_p123       218 NEK- -DHFLNNINVPNWNNMKSRTRLFYCTHFN 248

252                                                                              284
Sp_Tip1p      RNTVHMWLQWIFPRQFGLINAFQVKQLHKVIPL
Sc_Est2p      201 - - - - - -YSKILPSSS- - -SIKKLTDLREAIFP 223
Ea_p123       249 R- - - - -NNQFFKKHEFVSNKNNISAMDRAQTI 275

285                                                                              313
Sp_Tip1p      VS - - - -QSTVVPKRLLKVYPLIEQTAKRLHRIS
Sc_Est2p      224 TN - - - -LVKIPQRLKVRINLTLQKLLKRHKRLN 252
Ea_p123       276 FTNIFRFNRIRKKLKDKVIEKIAYMLEKVKDFN 308

314                                                                              342
Sp_Tip1p      LSKVYNHYCPYID-THDDEKILSYSLKPNQ- - -
Sc_Est2p      253 YVSILNSICPPLEGTVLDLSHLSRQSPKER- - - 282
Ea_p123       309 FNYYLTKSCPLPENWRERKQKIENLINKTREEK 341

343                                                                              359
Sp_Tip1p      - - - - - - - -VFAFLRSILVRVFPKLI
Sc_Est2p      283 - - - - - - - -VLKFIIVILQKLLPQEM 299
Ea_p123       342 SKYYEELFSYTTDNKCVTQFINEFFYNILPKDF 374

360                                                                              392
Sp_Tip1p      WGNQRLFEIILKDLETFLKLSRYESFSLHYLMS
Sc_Est2p      300 FGSKKNKGKIIKNLNLLSLPLNGYLPFDSLLK 332
Ea_p123       375 LTG-RNRKNFQKKVKKYVELNKHELIHKNLLLE 406

393                                                                              425
Sp_Tip1p      NIKISEIEWLVLGKRSNAKMCLSDFEKRKQIFA
Sc_Est2p      333 KLRLKDFRWLFIS- - -DIWFTKHNFENLNQLAI 362
Ea_p123       407 KINTREISWMQVETS-AKHFYYFDHEN- IYVLW 437
```

```
Sp_Tip1p  426 EFIYWLYNSFIIPILQSFFYITESSDLRNRTVY 458
Sc_Est2p  363 CFISWLFRQLIPKIIQTFFYCTEISSTVT-IVY 394
Ea_p123   438 KLLRWIFEDLVVSLIRCFFYVTEQQKSYSKTYY 470

Sp_Tip1p  459 FRKDIWKLLCRPFITSMKMEAFEKINENNVRMD 491
Sc_Est2p  395 FRHDTWNKLITPFIVEYFKTYLVENNVCRNHNS 427
Ea_p123   471 YRKNIWDVIMKMSIADLKKETLAEVQEKEVEEW 503

Sp_Tip1p  492 TQKTTLPPAVIRLLPKK--NTFRLITNLRKRFL 522
Sc_Est2p  428 YTLSNFNHSKMRIIPKKSNNEFRI--AIPCRGAD 460
Ea_p123   504 KKSLGFAPGKLRLIPKK--TTFRPIMTFNKKIV 534

Sp_Tip1p  523 IKMGSNKKMLVSTNQTLRPVASILKHLINE--- 552
Sc_Est2p  461 EEE--FTIYKENHKNAIQPTQKLLEYLRNKRPT 491
Ea_p123   535 NSD--RKTTKLTTNTKLLNSHLMLKTLKNR-MF 564

Sp_Tip1p  553 ESSGIPFNLEVYMKLLTFKKDLLKHRMFGR-KK 584
Sc_Est2p  492 SFTKLIYSPTQIADRIKEFKQRLLKKFNNVLPEL 524
Ea_p123   565 KDPFGFAVFNYDDVMKKYEEFVCKWKQVGQPKL 597

Sp_Tip1p  585 YFVRIDIKSCYDRIKQDLMFRIVKKLKDPE-F 616
Sc_Est2p  525 YFMKFDVKSCYDSIPRMECMRILKDALKNENGF 557
Ea_p123   598 FFATMDIEKCYDSVNREKLSTFLKTTKLLSSDF 630

Sp_Tip1p  617 VLRKYATIHATSDRATKN-------------- 634
Sc_Est2p  558 FVRSQYFFNTNTG------------------ 570
Ea_p123   631 WIMTAQILKRKNNIVIDSKNFRKKEMKDYFRQK 663
```

| | | | |
|---|---|---|---|
| Sp_Tip1p | 635 | F V S E A F S Y F D M V P F E K V V Q L L S - - M K T S D T L F V | 665 |
| Sc_Est2p | 571 | - - - - - - - - - V L K L F N V V N A S R - - V P K P Y E L Y I | 591 |
| Ea_p123 | 664 | F Q K I A L E G G Q Y P T L F S V L E N E Q N D L N A K K I L I V | 696 |

| | | | |
|---|---|---|---|
| Sp_Tip1p | 666 | D F V D Y W T K S S S E I F K M L K E H L S G H I V K I G N S Q Y | 698 |
| Sc_Est2p | 592 | D N V R T V H L S N Q D V I N V V E M E I F K T A L W V E D K C Y | 624 |
| Ea_p123 | 697 | E A K Q R N Y F K K D N L L Q P V I N I C Q Y N Y I N F N G K F Y | 729 |

| | | | |
|---|---|---|---|
| Sp_Tip1p | 699 | L Q K V G I P Q G S I L S S F L C H F Y M E D L I D E Y L S F T K | 731 |
| Sc_Est2p | 625 | I R E D G L F Q G S S L S A P I V D L V Y D D L L E F Y S E F K A | 657 |
| Ea_p123 | 730 | K Q T K G I P Q G L C V S S I L S S F Y Y A T L E E S S L G F L R | 762 |

| | | | |
|---|---|---|---|
| Sp_Tip1p | 732 | K K G - - - - - - - S V L L R V V D D F L F I T V N K K D A K K | 756 |
| Sc_Est2p | 658 | S P S Q D - - - - - T L I L K L A D D F L - - I S T D Q Q V I N | 684 |
| Ea_p123 | 763 | D E S M N P E N P N V N L L M R L T D D Y L L I T Q E N N A V L | 795 |

| | | | |
|---|---|---|---|
| Sp_Tip1p | 757 | F L N L S L R G F E K H N F S T S L E K T V I N F E N S N G - - - | 786 |
| Sc_Est2p | 685 | I K K L A M G G F Q K Y N A K A N R D K I L A V S S Q S D - - - | 713 |
| Ea_p123 | 796 | F I E K L I N V S R E N G F K F N M K K L Q T S F P L S P S K F A | 828 |

| | | | |
|---|---|---|---|
| Sp_Tip1p | 787 | - - - I N N T F F N E S K K R M P F F G F S V N M R S L D T L L | 816 |
| Sc_Est2p | 714 | - - - - D D T V I Q F C A - - - M H I F V K E L E V W K H S S T M | 739 |
| Ea_p123 | 829 | S V E E Q N I V Q D Y C D W I G I S I D M K T L A L M P | 861 |

| | | | |
|---|---|---|---|
| Sp_Tip1p | 817 | A C P K I D E A L F N S T S V E L T K H M G K S F F Y K I L R S S | 849 |
| Sc_Est2p | 740 | N N F H I R S K S S K G I F R S L I A L F N T R I S Y K T I D T N | 772 |
| Ea_p123 | 862 | N I N L R I E G I L C T L N L N M Q T K K A S M W L K K L K S F | 894 |

```
Sp_Tip1p    850  L A S F A Q V F I D T H N S K F N S C C N I Y R L G Y S M C M R   882
Sc_Est2p    773  L N S T N T V L M Q I D H V V K N I S E C - - - - - - - - - - -   793
Ea_p123     895  L M N N I T H Y F R K T I T T E D F A N K T L N K L F I S G G Y K   927

Sp_Tip1p    883  A Q A Y L K R M K D I F I P Q R M F I T D L L N V I G R K I W K K   915
Sc_Est2p    794  - - - Y K S A F K D L S I N - - V T Q N M Q F H S F L Q R I I E M   821
Ea_p123     928  Y M Q C A K E Y K D H F K K N L A M S S M I D L E V S K I I Y S V   960

Sp_Tip1p    916  L A E I L G Y T S R R F L S S A E V K W L F C L G M R D G L K P S   948
Sc_Est2p    822  T V S G C P I T K C D P L I E Y E V R F T I L N G F L E S L S S N   854
Ea_p123     961  T R A F F K Y L V C N I K D T I F G E E H Y P D F F L S T L K H F   993

Sp_Tip1p    949  F K Y H P C F E Q L I Y Q F Q S L T D L L I K P L R P V L R Q V L F   981
Sc_Est2p    855  T S - - - - - - - - - K F K D N I L L R K E I Q H L Q A Y I Y   877
Ea_p123     994  I E I F S - - - T K K Y I F N R V C M I L K A K E A K L K S D Q C   1023

Sp_Tip1p    982  L H R R I A D -                                                   988
Sc_Est2p    878  I Y I H I V N -                                                   884
Ea_p123     1024 Q S L I Q Y D A                                                   1031
```

```
Sp_Tip1p    1   - - - - - - - - - - - - - - - - - - - - - - - M T E H H T P K S R I L R F L E N Q Y V Y L C T   24
Sc_Est2p    1   - - - - - - - - - - - - - - - - - - - - - - - - - - - - - - - - - - - - - - M K I L F E F    7
Ea_p123     1   M E V D V D N Q A D N H G I H S A L K T C E E I K E A K T L Y S W                            33

Sp_Tip1p   25   L N D Y V Q L V L R G S P A S S Y S N I C E R L R S D V Q T S F S                           57
Sc_Est2p    8   I Q D K L D I D L Q T N - - S T Y K - - - E N L K C G H F N G L D                           35
Ea_p123    34   I Q K V I R C R N Q S Q - - S H Y K - - - D L E D I K I F A Q T N                           61

Sp_Tip1p   58   I F L H S T V V G F D S K P D E G V Q F S S P K C S Q S E L I A N                           90
Sc_Est2p   36   E I L T T C F A L P N S R - K I A L P C L P G D L S H K A V I D H                           67
Ea_p123    62   I V A T P R D Y N E E D F K V I A R K E V F S T G L M I E L L D K                           94

Sp_Tip1p   91   V V K Q M F D E S F E R R R - N L L M K G F S M N H E D F R A M H                          122
Sc_Est2p   68   C I Y L L T G E L Y N - - - N V L T F G Y K I A R N E D - - - -                             93
Ea_p123    95   C L V E L L S S S D V S D R Q K L Q C F G F Q L K G N Q - - - -                            122

Sp_Tip1p  123   V N G V Q N D L V S T F P N Y L I S I L E S K N W Q L L L E I I G                          155
Sc_Est2p   94   - - V N N S L F C H S A N V N V T L L K G A A W K M F H S L V G                            123
Ea_p123   123   - - - L A K T H L L T A L S T Q K Q Y F F Q D E W N Q V R A M I G                          152

Sp_Tip1p  156   S D A M H Y L L S K G S I F E A L P N D N Y L Q I S G I P L F K N                          188
Sc_Est2p  124   T Y A F V D L L I N Y T V I Q F N - G Q F F T Q I V G N R C N E P                          155
Ea_p123   153   N E L F R H L Y T K Y L I F Q R T S E G T L V Q F C G N N V F D H                          185

Sp_Tip1p  189   N V F E E T V S K K R K R T I E T S I T Q N - - - K S A R K E V S                          218
Sc_Est2p  156   H L P P K W V Q - - R S S S S A T A A Q I - - - K Q L T E P V T                            183
Ea_p123   186   L K V N D K F D K - K Q K G G A A D M N E P R C C S T C K Y N V K                          217
```

```
Sp_Tip1p  219  WNSISISRFSIFYRSSYKKFKQDLYFNLHSICD   251
Sc_Est2p  184  N------------KQFLHKLNINSSFFP        200
Ea_p123   218  NEK--DHFLNNINVPNWNNMKSRTRIFYCTHFN   248

Sp_Tip1p  252  RNTVHMWLQWIFPRQFGLINAFQVKQLHKVIPL   284
Sc_Est2p  201  ------YSKILPSSS--SIKKLTDLREAIFP     223
Ea_p123   249  R----NNQFFKKHEFVSNKNNISAMDRAQTI     275

Sp_Tip1p  285  VS----QSTVVPKRLLKVYPLIEQTAKRLHRIS   313
Sc_Est2p  224  TN----LVKIPQRLKVRINTLQKLLKRHKRLN   252
Ea_p123   276  FTNIFRFNRIRKKLKDKVIEKIAYMLEKVKDFN   308

Sp_Tip1p  314  LSKVYNHYCPYID-THDDEKILSYSLKPNQ---  342
Sc_Est2p  253  YVSILNSICPPLEGTVLDLSHLSRQSPKER---  282
Ea_p123   309  FNYYLTKSCPLPENWRERKQKIENLINKTREEK  341

Sp_Tip1p  343  ---------VFAFLRSI-LVRVFPKLI-       359
Sc_Est2p  283  ---------VLKFI--VILQKLLPQEM        299
Ea_p123   342  SKYYEELFSYTTDNKCVTQFINEFFYNILPKDF  374

Sp_Tip1p  360  WGNQRIFEI-ILKDLETFLKLSRYESFSLHYLMS  392
Sc_Est2p  300  FGSKKKNKGKI-IKNLNLLSLPLNGYLPFDSLLK  332
Ea_p123   375  LTG-RNRKNFQKKVKKYVELNKHELIHKNLLLE   406

Sp_Tip1p  393  NIKISEIEWLVLGKRSNAKMCLSDFEKRKQIFA   425
Sc_Est2p  333  KLRLKDFRWLFIS--DIWFTKHNFENLNQLAI   362
Ea_p123   407  KINTREISWMQVETS-AKHFYYFDHEN-IYVLW  437
```

| | | | | |
|---|---|---|---|---|
| Sp_Tip1p | 426 | EFIYWLYNSFIIPILQSFFYITESSDLRNRTVY | 458 |
| Sc_Est2p | 363 | CFISWLFRQLIPKIIQTFFYCTE-ISSTVT-IVY | 394 |
| Ea_p123 | 438 | KLLRWIFEDLVVSLIRCFFYVIEQQKSYSKTY | 470 |

| | | | | |
|---|---|---|---|---|
| Sp_Tip1p | 459 | FRKDIWKLLCRPFITSMKMEAFEKINENNVRMD | 491 |
| Sc_Est2p | 395 | FRHDTWNKLITPFIVEYFKTYLVENNVCRNHNS | 427 |
| Ea_p123 | 471 | YRKNIWDVIMKMSIADLKKETLAEVQEKEVEEW | 503 |

| | | | | |
|---|---|---|---|---|
| Sp_Tip1p | 492 | TQKTTLPPAVIRLLPKK--NTFRLITNLRKRFL | 522 |
| Sc_Est2p | 428 | YTLSNFNHSKMRI-IPKKSNNEFRI--AIPCRGAD | 460 |
| Ea_p123 | 504 | KKSLGFAPGKLIRLIPKK--TTFERPIMTFNKKIV | 534 |

| | | | | |
|---|---|---|---|---|
| Sp_Tip1p | 523 | IKMGSNKKMLVSTNQTLRPVASILKHLINE--- | 552 |
| Sc_Est2p | 461 | EEE--FTIYKENHKNAIQPTQKILEYLRNKRPT | 491 |
| Ea_p123 | 535 | NSD--RKTTKLTTNTKLLNSHLMLKTLKNR-MF | 564 |

| | | | | |
|---|---|---|---|---|
| Sp_Tip1p | 553 | ESSGIPFNLEVYMKLLTFKKDLLKHRMFGR-KK | 584 |
| Sc_Est2p | 492 | SFTKIYSPTQIADRIKEFKQRLLKKFNNVLPEL | 524 |
| Ea_p123 | 565 | KDPFGFAVFNYDDVMKKYEEFVCKWKQVGQPKL | 597 |

| | | | | |
|---|---|---|---|---|
| Sp_Tip1p | 585 | YFVRIDIKSCYDRIKQDLMFRIVKKKLKDPE-F | 616 |
| Sc_Est2p | 525 | YFMKFDVKSCYDSIPRMECMRILKDALKNENGF | 557 |
| Ea_p123 | 598 | FFATMDIEKCYDSVNREKLSTFLKTTKLLSSDF | 630 |

| | | | | |
|---|---|---|---|---|
| Sp_Tip1p | 617 | VIRKYATIHATSDRATKN-------- | 634 |
| Sc_Est2p | 558 | FVRSQYFFNTNTG------------- | 570 |
| Ea_p123 | 631 | WIMTAQILKRKNNIVIDSKNFRKKEMKDYFRQK | 663 |

| | | | |
|---|---|---|---|
| Sp_Tip1p | 635 | FVSEAFSYFDMVPFEKVVQLLS--MKTSDTLFV | 665 |
| Sc_Est2p | 571 | ------VLKLFNVVNASR--VPKPYELYI-V | 591 |
| Ea_p123 | 664 | FQKIALEGGQYPTLFSVLENEQNDLNAKKTLIV | 696 |
| | | | |
| Sp_Tip1p | 666 | DFVDYWTKSSSEIFKMLKEHLSGHIVKIGNSQY | 698 |
| Sc_Est2p | 592 | DNVRTVHLSNQDVINVVEMEIFKTALWVEDKCY | 624 |
| Ea_p123 | 697 | EAKQRNYFKKDNLLQPVINICQYNYINFNGKFY | 729 |
| | | | |
| Sp_Tip1p | 699 | LQKVGIPQGSI-LSSFLCHFYMEDLIDEYLSFTK | 731 |
| Sc_Est2p | 625 | IREDGLFQGSLSAPIVDLVYDDLLEFYSEFFKA | 657 |
| Ea_p123 | 730 | KQTKGIPQGLCVSSILSSFYYATLEESSLGFLR | 762 |
| | | | |
| Sp_Tip1p | 732 | KKG-----SVLLRVVDDFLFI--TVNKKDAKK | 756 |
| Sc_Est2p | 658 | SPSQD----TLILKLADDFLL-I--STDQQQVIN | 684 |
| Ea_p123 | 763 | DESMNPENPNVNLLMRLTDDYLLLITTQENNAVL | 795 |
| | | | |
| Sp_Tip1p | 757 | FLNLSLRGFEKHNFSTSLEKTVINFENSNG--- | 786 |
| Sc_Est2p | 685 | IKKLAMGGFQKYNAKANRDKILAVSSQSD---- | 713 |
| Ea_p123 | 796 | FIEKLINVSRENGFKFNMKKLQTSFPLSPSKFA | 828 |
| | | | |
| Sp_Tip1p | 787 | -IINNTFFNESKKRMPFFGFSVNMRSLDTLL | 816 |
| Sc_Est2p | 714 | ----DDTVIQFCA--MHIFVKELEVWKHSSTM | 739 |
| Ea_p123 | 829 | KYGMDSVEEQNIVQDYCDWIGISIDMKTLALMP | 861 |
| | | | |
| Sp_Tip1p | 817 | ACPKIDEALFNSTSVELTKHMGKSFFYKILRSS | 849 |
| Sc_Est2p | 740 | NNFHIRSKSSKGIFRSLIALFNTRISYKTIDTN | 772 |
| Ea_p123 | 862 | NINLRIEGILCTLNLMQTKKASMWLKKLKSF | 894 |

| | | | | |
|---|---|---|---|---|
| Sp_Tip1p | 850 | LASFAQVFIDITHNSKFNSCCNIYRLGYSMCMR | 882 |
| Sc_Est2p | 773 | LNSTNTVLMQIDHVVKNISEC----------- | 793 |
| Ea_p123 | 895 | LMNNITHYFRKTITTEDFANKTLNKLFISGGYK | 927 |

| | | | | |
|---|---|---|---|---|
| Sp_Tip1p | 883 | AQAYLKRMKDIFIPQRMFITDLLNVIGRKIWKK | 915 |
| Sc_Est2p | 794 | ---YKSAFKDLSIN--VTQNMQFHSFLQRIIEM | 821 |
| Ea_p123 | 928 | YMQCAKEYKDHFKKNLAMSSMIDLEVSKILYSV | 960 |

| | | | | |
|---|---|---|---|---|
| Sp_Tip1p | 916 | LAEILGYTSRRFLSSAEVKWLFCLGMRDGLKPS | 948 |
| Sc_Est2p | 822 | TVSGCPITKCDPLIEYEVRFTILNGFLESLSSN | 854 |
| Ea_p123 | 961 | TRAFFKYLVCNIKDTIFGEEHYPDFFLSTLKHF | 993 |

| | | | | |
|---|---|---|---|---|
| Sp_Tip1p | 949 | FKYHPCFEQLIYQFQSLTDLIKPLRPVLRQVLF | 981 |
| Sc_Est2p | 855 | TS-----KFKDNILLRKEIQHLQAYIY | 877 |
| Ea_p123 | 994 | IEIFS----TKKYIFNRVCMILKAKEAKLKSDQC | 1023 |

| | | | | |
|---|---|---|---|---|
| Sp_Tip1p | 982 | LHRRIAD- | 988 |
| Sc_Est2p | 878 | -IYIHIVN- | 884 |
| Ea_p123 | 1024 | QSLIQYDA | 1031 |

FIG. 64J

```
                                      1
                                      met ser val tyr val val glu leu leu
      GCCAAGTTCCTGCACTGGCTG           ATG AGT GTG TAC GTC GTC GAG CTG CTC 10                                                20
arg ser phe phe tyr val thr glu thr thr phe gln lys asn arg
AGG TCT TTC TTT TAT GTC ACG GAG ACC ACG TTT CAA AAG AAC AGG 30
leu phe phe tyr arg lys ser val trp ser lys leu gln ser ile
CTC TTT TTC TAC CGG AAG AGT GTC TGG AGC AAG TTG CAA AGC ATT 40                                                50
gly ile arg gln his leu lys arg val gln leu arg glu leu ser
GGA ATC AGA CAG CAC TTG AAG AGG GTG CAG CTG CGG GAG CTG TCG 60
glu ala glu val arg gln his arg glu ala arg pro ala leu leu
GAA GCA GAG GTC AGG CAG CAT CGG GAA GCC AGG CCC GCC CTG CTG 70                                                80
thr ser arg leu arg phe ile pro lys pro asp gly leu arg pro
ACG TCC AGA CTC CGC TTC ATC CCC AAG CCT GAC GGG CTG CGG CCG 90
ile val asn met asp tyr val val gly ala arg thr phe arg arg
ATT GTG AAC ATG GAC TAC GTC GTG GGA GCC AGA ACG TTC CGC AGA 100                                                110
glu lys     ala glu arg leu thr ser arg val lys ala leu phe
GAA AAG ARG GCC GAG CGT CTC ACC TCG AGG GTG AAG GCA CTG TTC 120
ser val leu asn tyr glu arg ala arg arg pro gly leu leu gly
AGC GTG CTC AAC TAC GAG CGG GCG CGG CGC CCC GGC CTC CTG GGC 130                                                140
ala ser val leu gly leu asp asp ile his arg ala trp arg thr
GCC TCT GTG CTG GGC CTG GAC GAT ATC CAC AGG GCC TGG CGC ACC 150
phe val leu arg val arg ala gln asp pro pro pro glu leu tyr
TTC GTG CTG CGT GTG CGG GCC CAG GAC CCG CCG CCT GAG CTG TAC 160                                                170
phe val lys val asp val thr gly ala tyr asp thr ile pro gln
TTT GTC AAG GTG GAT GTG ACG GGC GCG TAC GAC ACC ATC CCC CAG 180
asp arg leu thr glu val ile ala ser ile ile lys pro gln asn
GAC AGG CTC ACG GAG GTC ATC GCC AGC ATC ATC AAA CCC CAG AAC 190                                                200
thr tyr cys val arg arg tyr ala val val gln lys ala ala met
ACG TAC TGC GTG CGT CGG TAT GCC GTG GTC CAG AAG GCC GCC ATG
```

*FIG. 68A*

```
                              210
gly thr ser ala arg pro ser arg ala thr ser tyr val gln cys
GGC ACG TCC GCA AGG CCT TCA AGA GCC ACG TCC TAC GTC CAG TGC 220                                     230
gln gly ile pro gln gly ser ile leu ser thr leu leu cys ser
CAG GGG ATC CCG CAG GGC TCC ATC CTC TCC ACG CTG CTC TGC AGC 240
leu cys tyr gly asp met glu asn lys leu phe ala gly ile arg
CTG TGC TAC GGC GAC ATG GAG AAC AAG CTG TTT GCG GGG ATT CGG 250                                     260
arg asp gly leu leu leu arg leu val asp asp phe leu leu val
CGG GAC GGG CTG CTC CTG CGT TTG GTG GAT GAT TTC TTG TTG GTG 270
thr pro his leu thr his ala lys thr phe leu arg thr leu val
ACA CCT CAC CTC ACC CAC GCG AAA ACC TTC CTC AGG ACC CTG GTC 280                                     290
arg gly val pro glu tyr gly cys val val asn leu arg lys thr
CGA GGT GTC CCT GAG TAT GGC TGC GTG GTG AAC TTG CGG AAG ACA 300
val val asn phe pro val glu asp glu ala leu gly gly thr ala
GTG GTG AAC TTC CCT GTA GAA GAC GAG GCC CTG GGT GGC ACG GCT 310                                     320
phe val gln met pro ala his gly leu phe pro trp cys gly leu
TTT GTT CAG ATG CCG GCC CAC GGC CTA TTC CCC TGG TGC GGC CTG 330
leu leu asp thr arg thr leu glu val gln ser asp tyr ser ser
CTG CTG GAT ACC CGG ACC CTG GAG GTG CAG AGC GAC TAC TCC AGC 340                                     350
tyr ala arg thr ser ile arg ala ser leu thr phe asn arg gly
TAT GCC CGG ACC TCC ATC AGA GCC AGT CTC ACC TTC AAC CGC GGC 360
phe lys ala gly arg asn met arg arg lys leu phe gly val leu
TTC AAG GCT GGG AGG AAC ATG CGT CGC AAA CTC TTT GGG GTC TTG 370                                     380
arg leu lys cys his ser leu phe leu asp leu gln val asn ser
CGG CTG AAG TGT CAC AGC CTG TTT CTG GAT TTG CAG GTG AAC AGC 390
leu gln thr val cys thr asn ile tyr lys ile leu leu leu gln
CTC CAG ACG GTG TGC ACC AAC ATC TAC AAG ATC CTC CTG CTG CAG 400                                     410
ala tyr arg phe his ala cys val leu gln leu pro phe his gln
GCG TAC AGG TTT CAC GCA TGT GTG CTG CAG CTC CCA TTT CAT CAG
```

*FIG. 68B*

```
                        420
gln val trp lys asn pro his phe ser cys ala ser ser leu thr
CAA GTT TGG AAG AAC CCA CAT TTT TCC TGC GCG TCA TCT CTG ACA 430                                 440
arg leu pro leu leu leu his pro glu ser gln glu arg arg asp
CGG CTC CCT CTG CTA CTC CAT CCT GAA AGC CAA GAA CGC AGG GAT 450
val ala gly gly gln gly arg arg arg pro ser ala leu arg gly
GTC GCT GGG GGC CAA GGG CGC CGC CGG CCC TCT GCC CTC CGA GGC 460                                     470
arg ala val ala val pro pro ser ile pro ala gln ala asp ser
CGT GCA GTG GCT GTG CCA CCA AGC ATT CCT GCT CAA GCT GAC TCG 480
thr pro cys his leu arg ala thr pro gly val thr gln asp ser
ACA CCG TGT CAC CTA CGT GCC ACT CCT GGG GTC ACT CAG GAC AGC 490                                 500
pro asp ala ala glu ser glu ala pro gly asp asp ala asp cys
CCA GAC GCA GCT GAG TCG GAA GCT CCC GGG GAC GAC GCT GAC TGC 510
pro gly gly arg ser gln pro gly thr ala leu arg leu gln asp
CCT GGA GGC CGC AGC CAA CCC GGC ACT GCC CTC AGA CTT CAA GAC 520                                     530
his pro gly leu met ala thr arg pro gln pro gly arg glu gln
CAT CCT GGA CTG ATG GCC ACC CGC CCA CAG CCA GGC CGA GAG CAG 540
thr pro ala ala leu ser arg arg ala tyr thr ser gln gly gly
ACA CCA GCA GCC CTG TCA CGC CGG GCT TAT ACG TCC CAG GGA GGG 550                                 560
arg gly gly pro his pro gly leu his arg trp glu ser glu ala
AGG GGC GGC CCA CAC CCA GGC CTG CAC CGC TGG GAG TCT GAG GCC

564
OP
TGA GTGAGTGTTTGGCCGAGGCCTGCATGTCCGGCTGAAGGCTGAGTGTCCGGCTGAGGC

CTGAGCGAGTGTCCAGCCAAGGGCTGAGTGTCCAGCACACCTGCGTTTTCACTTCCCCAC

AGGCTGGCGTTCGGTCCACCCCAGGGCCAGCTTTTCCTCACCAGGAGCCCGGCTTCCACT

CCCCACATAGGAATAGTCCATCCCCAGATTCGCCATTGTTCACCCTTCGCCCTGCCTTCC

TTTGCCTTCCACCCCCACCATTCAGGTGGAGACCCTGAGAAGGACCCTGGGAGCTTTGGG

AATTTGGAGTGACCAAAGGTGTGCCCTGTACACAGGCGAGGACCCTGCACCTGGATGGGG

GTCCCTGTGGGTCAAATTGGGGGGAGGTGCTGTGGGAGTAAAATACTGAATATATGAGTT

TTTCAGTTTTGGAAAAAAAAAAAAAAAAAAAAAAAAA
```

FIG. 68C

```
Motif -1
Ep p123      ...LVVSLIRCFFYVTEQQKSYSKT...
Sp Tez1      ...FIIPILQSFFYITESSDLRNRT...
Sc Est2      ...LIPKIIQTFFYCTEISSTVTIV...
Hs TCP1      ...YVVELLRSFFYVTETTFQKNRL...
consensus             FFY TE K
Motif 0           p hhh  K      hR  h         R
Ep p123      ...KSLGFAPGKLRLIPKKT--TFRPIMTFNKKIV...
Sp Tez1      ...QKTTLPPAVIRLLPKKN--TFRLITNLRKRFL...
Sc Est2      ...TLSNFNHSKMRIIPKKSNNEFRIIAIPCRGAD...
Hs TCP1      ...ARPALLTSRLRFIPKPD--GLRPIVNMDYVVG...
consensus                  R  PK       R  I AF
Motif A          h  hDh  GY  h
Ep p123      ...PKLFFATMDIEKCYDSVNREKLSTFLK...
Sp Tez1      ...RKKYFVRIDIKSCYDRIKQDLMFRIVK...
Sc Est2      ...PELYFMKFDVKSCYDSIPRMECMRILK...
Hs TCP1      ...PELYFVKVDVTGAYDTIPQDRLTEVIA...//...
consensus         F   D    YD Motif B              hPQG   pS hh
Ep p123      ...NGKFYKQTKGIPQGLCVSSILSSFYYA...
Sp Tez1      ...GNSQYLQKVGIPQGSILSSFLCHFYME...
Sc Est2      ...EDKCYIREDGLFQGSSLSAPIVDLYD...
Hs TCP1      ...RATSYVQCQGIPQGSILSTLLCSLCYG...
consensus              G QG   S Y
Motif C          h  F DD hhh
Ep p123      ...PNVNLLMRLTDDYLLITTQENN...
Sp Tez1      ...KKGSVLLRVVDDFLFITVNKKD...
Sc Est2      ...SQDTLILKLADDFLIISTDQQQ...
Hs TCP1      ...RRDGLLLRLVDDFLLVTPHLTH...
consensus              DD L Motif D         Gh h  cK
Ep p123      ...NVSRENGFKFNMKKL...
Sp Tez1      ...LNLSLRGFEKHNFST...
Sc Est2      ...KKLAMGGFQKYNAKA...
Hs TCP1      ...LRTLVRGVPEYGCVV...
consensus           G
```

FIG. 69

```
   1  GCAGCGCTGC GTCCTGCTGC GCACGTGGGA AGCCCTGGCC CCGGCCACCC
  51  CCGCGATGCC GCGCGCTCCC CGCTGCCGAG CCGTGCGCTC CCTGCTGCGC
 101  AGCCACTACC GCGAGGTGCT GCCGCTGGCC ACGTTCGTGC GGCGCCTGGG
 151  GCCCCAGGGC TGGCGGCTGG TGCAGCGCGG GGACCCGGCG GCTTTCCGCG
 201  CGNTGGTGGC CCANTGCNTG GTGTGCGTGC CTGGGANGN ANGGCNGCCC
 251  CCCGCCGCCC CCTCCTTCCG CCAGGTGTCC TGCCTGAANG ANCTGGTGGC
 301  CCGAGTGCTG CANANGCTGT GCGANCGCGG CGCGAANAAC GTGCTGGCCT
 351  TCGGCTTCGC GCTGCTGGAC GGGGCCCGCG GGGCCCCCC CGAGGCCTTC
 401  ACCACCAGCG TGCGCAGCTA CCTGCCCAAC ACGGTGACCG ACGCACTGCG
 451  GGGGAGCGGG GCGTGGGGGC TGCTGCTGCG CCGCGTGGGC GACGACGTGC
 501  TGGTTCACCT GCTGGCACGC TGCGCGNTNT TTGTGCTGGT GGNTCCCAGC
 551  TGCGCCTACC ANGTGTGCGG GCCGCCGCTG TACCAGCTCG GCGCTGCNAC
 601  TCAGGCCCGG CCCCGCCAC ACGCTANTGG ACCCGAANGC GTCTGGGATC
 651  CAACGGGCCT GGAACCATAG CGTCAGGGAG GCCGGGGTCC CCCTGGGCTG
 701  CCAGCCCCGG GTGCGAGGAG GCGCGGGGGC AGTGCCAGCC GAAGTCTGCC
 751  GTTGCCCAAG AGGCCCAGGC GTGGCGCTGC CCCTGAGCCG GAGCGGACGC
 801  CCGTTGGGCA GGGGTCCTGG GCCCACCCGG GCAGGACGCC TGGACCGAGT
 851  GACCGTGGTT TCTGTGTGGT GTCACCTGCC AGACCCGCCG AAGAAGCCAC
 901  CTCTTTGGAG GGTGCGCTCT CTGGCACGCG CCACTCCCAC CCATCCGTGG
 951  GCCGCCAGCA CCACGCGGGC CCCCATCCA CATCGCGGCC ACCACGTCCT
1001  GGGACACGCC TTGTCCCCCG GTGTACGCCG AGACCAAGCA CTTCCTCTAC
1051  TCCTCAGGCG ACAAGNACAC TGCGNCCCTC CTTCCTACTC AATATATCTG
1101  AGGCCCAGCC TGACTGGCGT TCGGGAGGTT CGTGGAGACA NTCTTTCTGG
1151  TTCCAGGCCT TGGATGCCAG GATTCCCCGC AGGTTGCCCC GCCTGCCCCA
1201  GCGNTACTGG CAAATGCGGC CCTGTTTCT GGAGCTGCTT GGGAACCACG
1251  CGCAGTGCCC CTACGGGGTG TTCCTCAAGA CGCACTGCCC GCTGCGAGCT
1301  GCGGTCACCC CAGCAGCCGG TGTCTGTGCC CGGGAGAAGC CCCAGGGCTC
1351  TGTGGCGGCC CCCGAGGAGG AGGAACACAG ACCCCGTCG CCTGGTGCAG
1401  CTGCTCCGCC AGCACAGCAG CCCCTGGCAG GTGTACGGCT TCGTGCGGGC
1451  CTGCCTGCGC CGGCTGGTGC CCCCAGGCCT CTGGGGCTCC AGGCACAACG
1501  AACGCCGCTT CCTCAGGAAC ACCAAGAAGT TCATCTCCCT GGGGAAGCAT
1551  GCCAAGCTCT CGCTGCAGGA GCTGACGTGG AAGATGAGCG TGCGGGACTG
1601  CGCTTGGCTG CGCAGGAGCC CAGGGGTTGG CTGTGTTCCG GCCGCAGAGC
1651  ACCGTCTGCG TGAGGAGATC CTGGCCAAGT TCCTGCACTG GCTGATGAGT
1701  GTGTACGTCG TCGAGCTGCT CAGGTCTTTC TTTTATGTCA CGGAGACCAC
1751  GTTTCAAAAG AACAGGCTCT TTTTCTACCG GAAGAGTGTC TGGAGCAAGT
1801  TGCAAAGCAT TGGAATCAGA CAGCACTTGA AGAGGGTGCA GCTGCGGGAG
1851  CTGTCGGAAG CAGAGGTCAG GCAGCATCGG GAAGCCAGGC CCGCCCTGCT
1901  GACGTCCAGA CTCCGCTTCA TCCCCAAGCC TGACGGGCTG CGGCCGATTG
1951  TGAACATGGA CTACGTCGTG GGAGCAGAA CGTTCCGCAG AGAAAAGAGG
2001  3CCGAGCGTC TCACCTCGAG GGTGAAGGCA CTGTTCAGCG TGCTCAACTA
2051  CGAGCGGGCG CGGCGCCCCG CCTCCTGGG CGCCTCTGTG CTGGGCCTGG
2101  ACGATATCCA CAGGGCCTGG CGCACCTTCG TGCTGCGTGT GCGGGCCCAG
2151  GACCCGCCGC TGAGCTGTA CTTTGTCAAG GTGGATGTGA CGGGCGCGTA
2201  CGACACCATC CCCCAGGACA GGCTCACGGA GGTCATCGCC AGCATCATCA
2251  AACCCCAGAA CACGTACTGC GTGCGTCGGT ATGCCGTGGT CCAGAAGGCC
2301  GCCCATGGGC ACGTCCGCAA GGCCTTCAAG AGCCACGTCT CTACCTTGAC
2351  AGACCTCCAG CCGTACATGC GACAGTTCGT GGCTCACCTG CAGGANAACA
2401  GCCCGCTGAG GGATGCCGTC GTCATCGAGC AGAGCTCCTC CCTGAATGAG
2451  GCCAGCAGTG GCCTCTTCGA CGTCTTCCTA CGCTTCATGT GCCACCACGC
```

*FIG. 71A*

```
2501  CGTGCGCATC  AGGGGCAAGT  CCTACGTCCA  GTGCCAGGGG  ATCCCGCAGG
2551  GCTCCATCCT  CTCCACGCTG  CTCTGCAGCC  TGTGCTACGG  CGACATGGAG
2601  AACAAGCTGT  TTGCGGGGAT  TCGGCGGGAC  GGGCTGCTCC  TGCGTTTGGT
2651  GGATGATTTC  TTGTTGGTGA  CACCTCACCT  CACCCACGCG  AAAACCTTCC
2701  TCAGGACCCT  GGTCCGAGGT  GTCCTGAGT   ATGGCTGCGT  GGTGAACTTG
2751  CGGAAGACAG  TGGTGAACTT  CCCTGTAGAA  GACGAGGCCC  TGGGTGGCAC
2801  GGCTTTTGTT  CAGATGCCGG  CCCACGGCCT  ATTCCCTGG   TGCGGCCTGC
2851  TGCTGGATAC  CCGGACCCTG  GAGGTGCAGA  GCGACTACTC  CAGCTATGCC
2901  CGGACCTCCA  TCAGAGCCAG  TCTCACCTTC  AACCGCGGCT  TCAAGGCTGG
2951  GAGGAACATG  CGTCGCAAAC  TCTTTGGGGT  CTTGCGGCTG  AAGTGTCACA
3001  GCCTGTTTCT  GGATTTGCAG  GTGAACAGCC  TCCAGACGGT  GTGCACCAAC
3051  ATCTACAAGA  TCCTCCTGCT  GCAGGCGTAC  AGGTTTCACG  CATGTGTGCT
3101  GCAGCTCCCA  TTTCATCAGC  AAGTTTGGAA  GAACCCCACA  TTTTTCCTGC
3151  GCGTCATCTC  TGACACGGCC  TCCCTCTGCT  ACTCCATCCT  GAAAGCCAAG
3201  AACGCAGGA   TGTCGCTGGG  GGCCAAGGGC  GCCGCCGGCC  CTCTGCCCTC
3251  CGAGGCCGTG  CAGTGGCTGT  GCCACCAAGC  ATTCCTGCTC  AAGCTGACTC
3301  GACACCGTGT  CACCTACGTG  CCACTCCTGG  GGTCACTCAG  GACAGCCCAG
3351  ACGCAGCTGA  GTCGGAAGCT  CCCGGGGACG  ACGCTGACTG  CCCTGGAGGC
3401  CGCAGCCAAC  CCGGCACTGC  CCTCAGACTT  CAAGACCATC  CTGGACTGAT
3451  GGCCACCCGC  CCACAGCCAG  GCCGAGAGCA  GACACCAGCA  GCCCTGTCAC
3501  GCCGGGCTCT  ACGTCCCAGG  GAGGGAGGGG  CGGCCCACAC  CCAGGCCCGC
3551  ACCGCTGGGA  GTCTGAGGCC  TGAGTGAGTG  TTTGGCCGAG  GCCTGCATGT
3601  CCGGCTGAAG  GCTGAGTGTC  CGGCTGAGGC  CTGAGCGAGT  GTCCAGCCAA
3651  GGGCTGAGTG  TCCAGCACAC  CTGCCGTCTT  CACTTCCCCA  CAGGCTGGCG
3701  CTCGGCTCCA  CCCCAGGGCC  AGCTTTTCCT  CACCAGGAGC  CCGGCTTCCA
3751  CTCCCCACAT  AGGAATAGTC  CATCCCCAGA  TTCGCCATTG  TTCACCCCTC
3801  GCCCTGCCCT  CCTTTGCCTT  CCACCCCCAC  CATCCAGGTG  GAGACCCTGA
3851  GAAGGACCCT  GGGAGCTCTG  GAATTTGGA   GTGACCAAAG  GTGTGCCCTG
3901  TACACAGGCG  AGGACCCTGC  ACCTGGATGG  GGGTCCCTGT  GGGTCAAATT
3951  GGGGGGAGGT  GCTGTGGGAG  TAAAATACTG  AATATATGAG  TTTTTCAGTT
4001  TTGAAAAAAA  AAAAAAAAAA  AAAAAAAA
```

FIG. 71B

```
      GCAGCGCTGCGTCCTGCTGCGCACGTGGGAAGCCCTGGCCCCGGCCACCCCCGCGATGCC
    1 ---------+---------+---------+---------+---------+---------+ 60
      CGTCGCGACGCAGGACGACGCGTGCACCCTTCGGGACCGGGGCCGGTGGGGCGCTACGG
``` a     A A L R P A A H V G S P G P G H P R D A -
b       Q R C V L L R T W E A L A P A T P A M P -
c        S A A S C C A R G K P W P R P P P R C R -

```
      GCGCGCTCCCCGCTGCCGAGCCGTGCGCTCCCTGCTGCGCAGCCACTACCGCGAGGTGCT
   61 ---------+---------+---------+---------+---------+---------+ 120
      CGCGCGAGGGGCGACGGCTCGGCACGCGAGGGACGACGCGTCGGTGATGGCGCTCCACGA
``` a     A R S P L P S R A L P A A Q P L P R G A -
b       R A P R C R A V R S L L R S H Y R E V L -
c        A L P A A E P C A P C C A A T T A R C C -

```
      GCCGCTGGCCACGTTCGTGCGGCGCCTGGGGCCCCAGGGCTGGCGGCTGGTGCAGCGCGG
  121 ---------+---------+---------+---------+---------+---------+ 180
      CGGCGACCGGTGCAAGCACGCCGCGGACCCCGGGGTCCCGACCGCCGACCACGTCGCGCC
``` a     A A G H V R A A P G A P G L A A G A A R -
b       P L A T F V R R L G P Q G W R L V Q R G -
c        R W P R S C G A W G P R A G G W C S A G -

```
      GGACCCGGCGGCTTTCCGCGCGNTGGTGGCCCANTGCNTGGTGTGCGTGCCCTGGGANGN
  181 ---------+---------+---------+---------+---------+---------+ 240
      CCTGGGCCGCCGAAAGGCGCGCNACCACCGGGTNACGNACCACACGCACGGGACCCTNCN
``` a     G P G G F P R ? G G P ? ? G V R A L G ? -
b       D P A A F R A ? V A ? C ? V C V P W ? ? -
c        T R R L S A R W W P ? A W C A C P G ? ? -

```
      ANGGCNGCCCCCCGCCGCCCCCTCCTTCCGCCAGGTGTCCTGCCTGAANGANCTGGTGGC
  241 ---------+---------+---------+---------+---------+---------+ 300
      TNCCGNCGGGGGGCGGCGGGGGAGGAAGGCGGTCCACAGGACGGACTTNCTNGACCACCG
``` a     ? A A P R R P L L P P G V L P E ? ? G G -
b       ? ? P P A A P S F R Q V S C L ? ? L V A -
c        G ? P P P P P P S A R C P A * ? ? W W P -

```
      CCGAGTGCTGCANANGCTGTGCGANCGCGGCGCGAANAACGTGCTGGCCTTCGGCTTCGC
  301 ---------+---------+---------+---------+---------+---------+ 360
      GGCTCACGACGTNTNCGACACGCTNGCGCCGCGCTTNTTGCACGACCGGAAGCCGAAGCG
``` a     P S A A ? A V R ? R R E ? R A G L R L R -
b       R V L ? ? L C ? R G A ? N V L A F G F A -
c        E C C ? ? C A ? A A R ? T C W P S A S R -

```
      GCTGCTGGACGGGGCCCGCGGGGGCCCCCCCGAGGCCTTCACCACCAGCGTGCGCAGCTA
  361 ---------+---------+---------+---------+---------+---------+ 420
      CGACGACCTGCCCCGGGCGCCCCCGGGGGGGCTCCGGAAGTGGTGGTCGCACGCGTCGAT
``` a     A A G R G P R G P P R G L H H Q R A Q L -
b       L L D G A R G G P P E A F T T S V R S Y -
c        C W T G P A G A P P R P S P P A C A A T -

```
      CCTGCCCAACACGGTGACCGACGCACTGCGGGGGAGCGGGGCGTGGGGGCTGCTGCTGCG
  421 ---------+---------+---------+---------+---------+---------+ 480
      GGACGGGTTGTGCCACTGGCTGCGTGACGCCCCCTCGCCCCGCACCCCCGACGACGACGC
``` a     P A Q H G D R R T A G E R G V G A A A A -
b       L P N T V T D A L R G S G A W G L L L R -
c        C P T R * P T H C G G A G R G G C C C A -

GGNTCCCAGCTGCGCCTACCANGTGTGCGGGCCGCCGCTGTACCAGCTCGGCGCTGCNAC
541  ---------+---------+---------+---------+---------+---------+ 600
     CCNAGGGTCGACGCGGATGGTNCACACGCCCGGCGGCGACATGGTCGAGCCGCGACGNTG a    G S Q L R L P ? V R A A A V P A R R C ?     -
b      ? P S C A Y ? V C G P P L Y Q L G A A T   -
c        ? P A A P T ? C A G R R C T S S A L ? L -

TCAGGCCCGGCCCCCGCCACACGCTANTGGACCCGAANGCGTCTGGGATCCAACGGGCCT
601  ---------+---------+---------+---------+---------+---------+ 660
     AGTCCGGGCCGGGGGCGGTGTGCGATNACCTGGGCTTNCGCAGACCCTAGGTTGCCCGGA a    S G P A P A T R ? W T R ? R L G S N G P     -
b      Q A R P P P H A ? G P E ? V W D P T G L   -
c        R P G P R H T L ? D P ? A S G I Q R A W -

GGAACCATAGCGTCAGGGAGGCCGGGGTCCCCCTGGGCTGCCAGCCCCGGGTGCGAGGAG
661  ---------+---------+---------+---------+---------+---------+ 720
     CCTTGGTATCGCAGTCCCTCCGGCCCCAGGGGGACCCGACGGTCGGGGCCCACGCTCCTC a    G T I A S G R P G S P W A A S P G C E E     -
b      E P * R Q G G R G P P G L P A P G A R R   -
c        N H S V R E A G V P L G C Q P R V R G G -

GCGCGGGGGCAGTGCCAGCCGAAGTCTGCCGTTGCCCAAGAGGCCCAGGCGTGGCGCTGC
721  ---------+---------+---------+---------+---------+---------+ 780
     CGCGCCCCCGTCACGGTCGGCTTCAGACGGCAACGGGTTCTCCGGGTCCGCACCGCGACG a    A R G Q C Q P K S A V A Q E A Q A W R C     -
b      R G G S A S R S L P L P K R P R R G A A   -
c        A G A V P A E V C R C P R G P G V A L P -

CCCTGAGCCGGAGCGGACGCCCGTTGGGCAGGGGTCCTGGGCCCACCCGGGCAGGACGCC
781  ---------+---------+---------+---------+---------+---------+ 840
     GGGACTCGGCCTCGCCTGCGGGCAACCCGTCCCCAGGACCCGGGTGGGCCCGTCCTGCGG a    P * A G A D A R W A G V L G P P G Q D A     -
b      P E P E R T P V G Q G S W A H P G R T P   -
c        L S R S G R P L G R G P G P T R A G R L -

TGGACCGAGTGACCGTGGTTTCTGTGTGGTGTCACCTGCCAGACCCGCCGAAGAAGCCAC
841  ---------+---------+---------+---------+---------+---------+ 900
     ACCTGGCTCACTGGCACCAAAGACACACCACAGTGGACGGTCTGGGCGGCTTCTTCGGTG a    W T E * P W F L C G V T C Q T R R R S H     -
b      G P S D R G F C V V S P A R P A E E A T   -
c        D R V T V V S V W C H L P D P P K K P P -

CTCTTTGGAGGGTGCGCTCTCTGGCACGCGCCACTCCCACCCATCCGTGGGCCGCCAGCA
901  ---------+---------+---------+---------+---------+---------+ 960
     GAGAAACCTCCCACGCGAGAGACCGTGCGCGGTGAGGGTGGGTAGGCACCCGGCGGTCGT a    L F G G C A L W H A P L P P I R G P P A     -
b      S L E G A L S G T R H S H P S V G R Q H   -
c        L W R V R S L A R A T P T H P W A A S T -

CCACGCGGGCCCCCCATCCACATCGCGGCCACCACGTCCTGGGACACGCCTTGTCCCCCG
961  ---------+---------+---------+---------+---------+---------+ 1020
     GGTGCGCCCGGGGGGTAGGTGTAGCGCCGGTGGTGCAGGACCCTGTGCGGAACAGGGGGC
```

GTGTACGCCGAGACCAAGCACTTCCTCTACTCCTCAGGCGACAAGNACACTGCGNCCCTC
1021    ---------+---------+---------+---------+---------+---------+ 1080
        CACATGCGGCTCTGGTTCGTGAAGGAGATGAGGAGTCCGCTGTTCNTGTGACGCNGGGAG a       V Y A E T K H F L Y S S G D K ? T A ? L       -
b         C T P R P S T S S T P Q A T ? T L R P S    -
c           V R R D Q A L P L L L R R Q ? H C ? P P  -

CTTCCTACTCAATATATCTGAGGCCCAGCCTGACTGGCGTTCGGGAGGTTCGTGGAGACA
1081    ---------+---------+---------+---------+---------+---------+ 1140
        GAAGGATGAGTTATATAGACTCCGGGTCGGACTGACCGCAAGCCCTCCAAGCACCTCTGT a       L P T Q Y I * G P A * L A F G R F V E T       -
b         F L L N I S E A Q P D W R S G G S W R ?    -
c           S Y S I Y L R P S L T G V R E V R G D ?  -

NTCTTTCTGGTTCCAGGCCTTGGATGCCAGGATTCCCCGCAGGTTGCCCCGCCTGCCCCA
1141    ---------+---------+---------+---------+---------+---------+ 1200
        NAGAAAGACCAAGGTCCGGAACCTACGGTCCTAAGGGGCGTCCAACGGGGCGGACGGGGT a       ? F L V P G L G C Q D S P Q V A P P A P       -
b         S F W F Q A L D A R I P R R L P R L P Q    -
c           L S G S R P W M P G F P A G C P A C P S  -

GCGNTACTGGCAAATGCGGCCCCTGTTTCTGGAGCTGCTTGGGAACCACGCGCAGTGCCC
1201    ---------+---------+---------+---------+---------+---------+ 1260
        CGCNATGACCGTTTACGCCGGGGACAAAGACCTCGACGAACCCTTGGTGCGCGTCACGGG a       A ? L A N A A P V S G A A W E P R A V P       -
b         R Y W Q M R P L F L E L L G N H A Q C P    -
c           ? T G K C G P C F W S C L G T T R S A P  -

CTACGGGGTGTTCCTCAAGACGCACTGCCCGCTGCGAGCTGCGGTCACCCCAGCAGCCGG
1261    ---------+---------+---------+---------+---------+---------+ 1320
        GATGCCCCACAAGGAGTTCTGCGTGACGGGCGACGCTCGACGCCAGTGGGGTCGTCGGCC a       L R G V P Q D A L P A A S C G H P S S R       -
b         Y G V F L K T H C P L R A A V T P A A G    -
c           T G C S S R R T A R C E L R S P Q Q P V  -

TGTCTGTGCCCGGGAGAAGCCCCAGGGCTCTGTGGCGGCCCCCGAGGAGGAGGAACACAG
1321    ---------+---------+---------+---------+---------+---------+ 1380
        ACAGACACGGGCCCTCTTCGGGGTCCCGAGACACCGCCGGGGCTCCTCCTCCTTGTGTC a       C L C P G E A P G L C G G P R G G G T Q       -
b         V C A R E K P Q G S V A A P E E E E H R    -
c           S V P G R S P R A L W R P P R R R N T D  -

ACCCCCGTCGCCTGGTGCAGCTGCTCCGCCAGCACAGCAGCCCCTGGCAGGTGTACGGCT
1381    ---------+---------+---------+---------+---------+---------+ 1440
        TGGGGGCAGCGGACCACGTCGACGAGGCGGTCGTGTCGTCGGGGACCGTCCACATGCCGA a       T P V A W C S C S A S T A A P G R C T A       -
b         P P S P G A A A P P A Q Q P L A G V R L    -
c           P R R L V Q L L R Q H S S P W Q V Y G F  -

TCGTGCGGGCCTGCCTGCGCCGGCTGGTGCCCCAGGCCTCTGGGGCTCCAGGCACAACG
1441    ---------+---------+---------+---------+---------+---------+ 1500
        AGCACGCCCGGACGGACGCGGCCGACCACGGGGGTCCGGAGACCCCGAGGTCCGTGTTGC
```

AACGCCGCTTCCTCAGGAACACCAAGAAGTTCATCTCCCTGGGGAAGCATGCCAAGCTCT
  1501  ---------+---------+---------+---------+---------+---------+ 1560
        TTGCGGCGAAGGAGTCCTTGTGGTTCTTCAAGTAGAGGGACCCCTTCGTACGGTTCGAGA a       N A A S S G T P R S S S P W G S M P S S   -
b         T P L P Q E H Q E V H L P G E A C Q A L -
c           R R F L R N T K K F I S L G K H A K L S -

CGCTGCAGGAGCTGACGTGGAAGATGAGCGTGCGGGACTGCGCTTGGCTGCGCAGGAGCC
  1561  ---------+---------+---------+---------+---------+---------+ 1620
        GCGACGTCCTCGACTGCACCTTCTACTCGCACGCCCTGACGCGAACCGACGCGTCCTCGG a       R C R S * R G R * A C G T A L G C A G A   -
b         A A G A D V E D E R A G L R L A A Q E P -
c           L Q E L T W K M S V R D C A W L R R S P -

CAGGGGTTGGCTGTGTTCCGGCCGCAGAGCACCGTCTGCGTGAGGAGATCCTGGCCAAGT
  1621  ---------+---------+---------+---------+---------+---------+ 1680
        GTCCCCAACCGACACAAGGCCGGCGTCTCGTGGCAGACGCACTCCTCTAGGACCGGTTCA a       Q G L A V F R P Q S T V C V R R S W P S   -
b         R G W L C S G R R A P S A * G D P G Q V -
c           G V G C V P A A E H R L R E E I L A K F -

TCCTGCACTGGCTGATGAGTGTGTACGTCGTCGAGCTGCTCAGGTCTTTCTTTTATGTCA
  1681  ---------+---------+---------+---------+---------+---------+ 1740
        AGGACGTGACCGACTACTCACACATGCAGCAGCTCGACGAGTCCAGAAAGAAAATACAGT a       S C T G * * V C T S S S C S G L S F M S   -
b         P A L A D E C V R R R A A Q V F L L C H -
c           L H W L M S V Y V V E L L R S F F Y V T -

CGGAGACCACGTTTCAAAAGAACAGGCTCTTTTTCTACCGGAAGAGTGTCTGGAGCAAGT
  1741  ---------+---------+---------+---------+---------+---------+ 1800
        GCCTCTGGTGCAAAGTTTTCTTGTCCGAGAAAAAGATGGCCTTCTCACAGACCTCGTTCA a       R R P R F K R T G S F S T G R V S G A S   -
b         G D H V S K E Q A L F L P E E C L E Q V -
c           E T T F Q K N R L F F Y R K S V W S K L -

TGCAAAGCATTGGAATCAGACAGCACTTGAAGAGGGTGCAGCTGCGGGAGCTGTCGGAAG
  1801  ---------+---------+---------+---------+---------+---------+ 1860
        ACGTTTCGTAACCTTAGTCTGTCGTGAACTTCTCCCACGTCGACGCCCTCGACAGCCTTC a       C K A L E S D S T * R G C S C G S C R K   -
b         A K H W N Q T A L E E G A A A G A V G S -
c           Q S I G I R Q H L K R V Q L R E L S E A -

CAGAGGTCAGGCAGCATCGGGAAGCCAGGCCCGCCCTGCTGACGTCCAGACTCCGCTTCA
  1861  ---------+---------+---------+---------+---------+---------+ 1920
        GTCTCCAGTCCGTCGTAGCCCTTCGGTCCGGGCGGGACGACTGCAGGTCTGAGGCGAAGT a       Q R S G S I G K P G P P C * R P D S A S   -
b         R G Q A A S G S Q A R P A D V Q T P L H -
c           E V R Q H R E A R P A L L T S R L R F I -

TCCCCAAGCCTGACGGGCTGCGGCCGATTGTGAACATGGACTACGTCGTGGGAGCCAGAA
  1921  ---------+---------+---------+---------+---------+---------+ 1980
        AGGGGTTCGGACTGCCCGACGCCGGCTAACACTTGTACCTGATGCAGCACCCTCGGTCTT
```

CGTTCCGCAGAGAAAAGAGGGCCGAGCGTCTCACCTCGAGGGTGAAGGCACTGTTCAGCG
   1981 ---------+---------+---------+---------+---------+---------+ 2040
        GCAAGGCGTCTCTTTTCTCCCGGCTCGCAGAGTGGAGCTCCCACTTCCGTGACAAGTCGC a       R  S  A  E  K  R  G  P  S  V  S  P  R  G  *  R  H  C  S  A   -
b        V  P  Q  R  K  E  G  R  A  S  H  L  E  G  E  G  T  V  Q  R  -
c         F  R  R  E  K  R  A  E  R  L  T  S  R  V  K  A  L  F  S  V -

TGCTCAACTACGAGCGGGCGCGGCGCCCCGGCCTCCTGGGCGCCTCTGTGCTGGGCCTGG
   2041 ---------+---------+---------+---------+---------+---------+ 2100
        ACGAGTTGATGCTCGCCCGCGCCGCGGGGCCGGAGGACCCGCGGAGACACGACCCGGACC a       C  S  T  T  S  G  R  G  A  P  A  S  W  A  P  L  C  W  A  W   -
b        A  Q  L  R  A  G  A  A  P  R  P  P  G  R  L  C  A  G  P  G  -
c         L  N  Y  E  R  A  R  R  P  G  L  L  G  A  S  V  L  G  L  D -

ACGATATCCACAGGGCCTGGCGCACCTTCGTGCTGCGTGTGCGGGCCCAGGACCCGCCGC
   2101 ---------+---------+---------+---------+---------+---------+ 2160
        TGCTATAGGTGTCCCGGACCGCGTGGAAGCACGACGCACACGCCCGGGTCCTGGGCGGCG a       T  I  S  T  G  P  G  A  P  S  C  C  V  C  G  P  R  T  R  R   -
b        R  Y  P  Q  G  L  A  H  L  R  A  A  C  A  G  P  G  P  A  A  -
c         D  I  H  R  A  W  R  T  F  V  L  R  V  R  A  Q  D  P  P  P -

CTGAGCTGTACTTTGTCAAGGTGGATGTGACGGGCGCGTACGACACCATCCCCCAGGACA
   2161 ---------+---------+---------+---------+---------+---------+ 2220
        GACTCGACATGAAACAGTTCCACCTACACTGCCCGCGCATGCTGTGGTAGGGGGTCCTGT a       L  S  C  T  L  S  R  W  M  *  R  A  R  T  T  P  S  P  R  T   -
b        *  A  V  L  C  Q  G  G  C  D  G  R  V  R  H  H  P  P  G  Q  -
c         E  L  Y  F  V  K  V  D  V  T  G  A  Y  D  T  I  P  Q  D  R -

GGCTCACGGAGGTCATCGCCAGCATCATCAAACCCCAGAACACGTACTGCGTGCGTCGGT
   2221 ---------+---------+---------+---------+---------+---------+ 2280
        CCGAGTGCCTCCAGTAGCGGTCGTAGTAGTTTGGGGTCTTGTGCATGACGCACGCAGCCA a       G  S  R  R  S  S  P  A  S  S  N  P  R  T  R  T  A  C  V  G   -
b        A  H  G  G  H  R  Q  H  H  Q  T  P  E  H  V  L  R  A  S  V  -
c         L  T  E  V  I  A  S  I  I  K  P  Q  N  T  Y  C  V  R  R  Y -

ATGCCGTGGTCCAGAAGGCCGCCCATGGGCACGTCCGCAAGGCCTTCAAGAGCCACGTCT
   2281 ---------+---------+---------+---------+---------+---------+ 2340
        TACGGCACCAGGTCTTCCGGCGGGTACCCGTGCAGGCGTTCCGGAAGTTCTCGGTGCAGA a       M  P  W  S  R  R  P  P  M  G  T  S  A  R  P  S  R  A  T  S   -
b        C  R  G  P  E  G  R  P  W  A  R  P  Q  G  L  Q  E  P  R  L  -
c         A  V  V  Q  K  A  A  H  G  H  V  R  K  A  F  K  S  H  V  S -

CTACCTTGACAGACCTCCAGCCGTACATGCGACAGTTCGTGGCTCACCTGCAGGANAACA
   2341 ---------+---------+---------+---------+---------+---------+ 2400
        GATGGAACTGTCTGGAGGTCGGCATGTACGCTGTCAAGCACCGAGTGGACGTCCTNTTGT a       L  P  *  Q  T  S  S  R  T  C  D  S  S  W  L  T  C  R  ?  T   -
b        Y  L  D  R  P  P  A  V  H  A  T  V  R  G  S  P  A  G  ?  Q  -
c         T  L  T  D  L  Q  P  Y  M  R  Q  F  V  A  H  L  Q  ?  N  S -

GCCCGCTGAGGGATGCCGTCGTCATCGAGCAGAGCTCCTCCCTGAATGAGGCCAGCAGTG
   2401 ---------+---------+---------+---------+---------+---------+ 2460
        CGGGCGACTCCCTACGGCAGCAGTAGCTCGTCTCGAGGAGGGACTTACTCCGGTCGTCAC
```

GCCTCTTCGACGTCTTCCTACGCTTCATGTGCCACCACGCCGTGCGCATCAGGGGCAAGT
   2461 ------------+---------+---------+---------+---------+---------+ 2520
        CGGAGAAGCTGCAGAAGGATGCGAAGTACACGGTGGTGCGGCACGCGTAGTCCCCGTTCA a        A S S T S S Y A S C A T T P C A S G A S     -
b          P L R R L P T L H V P P R R A H Q G Q V   -
c            L F D V F L R F M C H H A V R I R G K S -

CCTACGTCCAGTGCCAGGGGATCCCGCAGGGCTCCATCCTCTCCACGCTGCTCTGCAGCC
   2521 ---------+---------+---------+---------+---------+---------+ 2580
        GGATGCAGGTCACGGTCCCCTAGGGCGTCCCGAGGTAGGAGAGGTGCGACGAGACGTCGG a        P T S S A R G S R R A P S S P R C S A A     -
b          L R P V P G D P A G L H P L H A A L Q P   -
c            Y V Q C Q G I P Q G S I L S T L L C S L -

TGTGCTACGGCGACATGGAGAACAAGCTGTTTGCGGGGATTCGGCGGGACGGGCTGCTCC
   2581 ---------+---------+---------+---------+---------+---------+ 2640
        ACACGATGCCGCTGTACCTCTTGTTCGACAAACGCCCCTAAGCCGCCCTGCCCGACGAGG a        C A T A T W R T S C L R G F G G T G C S     -
b          V L R R H G E Q A V C G D S A G R A A P   -
c            C Y G D M E N K L F A G I R R D G L L L -

TGCGTTTGGTGGATGATTTCTTGTTGGTGACACCTCACCTCACCCACGCGAAAACCTTCC
   2641 ---------+---------+---------+---------+---------+---------+ 2700
        ACGCAAACCACCTACTAAAGAACAACCACTGTGGAGTGGAGTGGGTGCGCTTTTGGAAGG a        C V W W M I S C W * H L T S P T R K P S     -
b          A F G G * F L V G D T S P H P R E N L P   -
c            R L V D D F L L V T P H L T H A K T F L -

TCAGGACCCTGGTCCGAGGTGTCCCTGAGTATGGCTGCGTGGTGAACTTGCGGAAGACAG
   2701 ---------+---------+---------+---------+---------+---------+ 2760
        AGTCCTGGGACCAGGCTCCACAGGGACTCATACCGACGCACCACTTGAACGCCTTCTGTC a        S G P W S E V S L S M A A W * T C G R Q     -
b          Q D P G P R C P * V W L R G E L A E D S   -
c            R T L V R G V P E Y G C V V N L R K T V -

TGGTGAACTTCCCTGTAGAAGACGAGGCCCTGGGTGGCACGGCTTTTGTTCAGATGCCGG
   2761 ---------+---------+---------+---------+---------+---------+ 2820
        ACCACTTGAAGGGACATCTTCTGCTCCGGGACCCACCGTGCCGAAAACAAGTCTACGGCC a        W * T S L * K T R P W V A R L L F R C R     -
b          G E L P C R R R G P G W H G F C S D A G   -
c            V N F P V E D E A L G G T A F V Q M P A -

CCCACGGCCTATTCCCCTGGTGCGGCCTGCTGCTGGATACCCGGACCCTGGAGGTGCAGA
   2821 ---------+---------+---------+---------+---------+---------+ 2880
        GGGTGCCGGATAAGGGGACCACGCCGGACGACGACCTATGGGCCTGGGACCTCCACGTCT a        P T A Y S P G A A C C W I P G P W R C R     -
b          P R P I P L V R P A A G Y P D P G G A E   -
c            H G L F P W C G L L L D T R T L E V Q S -

GCGACTACTCCAGCTATGCCCGGACCTCCATCAGAGCCAGTCTCACCTTCAACCGCGGCT
   2881 ---------+---------+---------+---------+---------+---------+ 2940
        CGCTGATGAGGTCGATACGGGCCTGGAGGTAGTCTCGGTCAGAGTGGAAGTTGGCGCCGA
```

TCAAGGCTGGGAGGAACATGCGTCGCAAACTCTTTGGGGTCTTGCGGCTGAAGTGTCACA
   2941   ---------+---------+---------+---------+---------+---------+ 3000
          AGTTCCGACCCTCCTTGTACGCAGCGTTTGAGAAACCCCAGAACGCCGACTTCACAGTGT a          S  R  L  G  G  T  C  V  A  N  S  L  G  S  C  G  *  S  V  T  -
b          Q  G  W  E  E  H  A  S  Q  T  L  W  G  L  A  A  E  V  S  Q  -
c            K  A  G  R  N  M  R  R  K  L  F  G  V  L  R  L  K  C  H  S -

GCCTGTTTCTGGATTTGCAGGTGAACAGCCTCCAGACGGTGTGCACCAACATCTACAAGA
   3001   ---------+---------+---------+---------+---------+---------+ 3060
          CGGACAAAGACCTAAACGTCCACTTGTCGGAGGTCTGCCACACGTGGTTGTAGATGTTCT a          A  C  F  W  I  C  R  *  T  A  S  R  R  C  A  P  T  S  T  R  -
b          P  V  S  G  F  A  G  E  Q  P  P  D  G  V  H  Q  H  L  Q  D  -
c            L  F  L  D  L  Q  V  N  S  L  Q  T  V  C  T  N  I  Y  K  I -

TCCTCCTGCTGCAGGCGTACAGGTTTCACGCATGTGTGCTGCAGCTCCCATTTCATCAGC
   3061   ---------+---------+---------+---------+---------+---------+ 3120
          AGGAGGACGACGTCCGCATGTCCAAAGTGCGTACACACGACGTCGAGGGTAAAGTAGTCG a          S  S  C  C  R  R  T  G  F  T  H  V  C  C  S  S  H  F  I  S  -
b          P  P  A  A  G  V  Q  V  S  R  M  C  A  A  A  P  I  S  S  A  -
c            L  L  L  Q  A  Y  R  F  H  A  C  V  L  Q  L  P  F  H  Q  Q -

AAGTTTGGAAGAACCCCACATTTTTCCTGCGCGTCATCTCTGACACGGCCTCCCTCTGCT
   3121   ---------+---------+---------+---------+---------+---------+ 3180
          TTCAAACCTTCTTGGGGTGTAAAAAGGACGCGCAGTAGAGACTGTGCCGGAGGGAGACGA a          K  F  G  R  T  P  H  F  S  C  A  S  S  L  T  R  P  P  S  A  -
b          S  L  E  E  P  H  I  F  P  A  R  H  L  *  H  G  L  P  L  L  -
c            V  W  K  N  P  T  F  F  L  R  V  I  S  D  T  A  S  L  C  Y -

ACTCCATCCTGAAAGCCAAGAACGCAGGGATGTCGCTGGGGGCCAAGGGCGCCGCCGGCC
   3181   ---------+---------+---------+---------+---------+---------+ 3240
          TGAGGTAGGACTTTCGGTTCTTGCGTCCCTACAGCGACCCCCGGTTCCCGCGGCGGCCGG a          T  P  S  *  K  P  R  T  Q  G  C  R  W  G  P  R  A  P  P  A  -
b          L  H  P  E  S  Q  E  R  R  D  V  A  G  G  Q  G  R  R  R  P  -
c            S  I  L  K  A  K  N  A  G  M  S  L  G  A  K  G  A  A  G  P -

CTCTGCCCTCCGAGGCCGTGCAGTGGCTGTGCCACCAAGCATTCCTGCTCAAGCTGACTC
   3241   ---------+---------+---------+---------+---------+---------+ 3300
          GAGACGGGAGGCTCCGGCACGTCACCGACACGGTGGTTCGTAAGGACGAGTTCGACTGAG a          L  C  P  P  R  P  C  S  G  C  A  T  K  H  S  C  S  S  *  L  -
b          S  A  L  R  G  R  A  V  A  V  P  P  S  I  P  A  Q  A  D  S  -
c            L  P  S  E  A  V  Q  W  L  C  H  Q  A  F  L  L  K  L  T  R -

GACACCGTGTCACCTACGTGCCACTCCTGGGGTCACTCAGGACAGCCCAGACGCAGCTGA
   3301   ---------+---------+---------+---------+---------+---------+ 3360
          CTGTGGCACAGTGGATGCACGGTGAGGACCCCAGTGAGTCCTGTCGGGTCTGCGTCGACT a          D  T  V  S  P  T  C  H  S  W  G  H  S  G  Q  P  R  R  S  *  -
b          T  P  C  H  L  R  A  T  P  G  V  T  Q  D  S  P  D  A  A  E  -
c            H  R  V  T  Y  V  P  L  L  G  S  L  R  T  A  Q  T  Q  L  S -

GTCGGAAGCTCCCGGGGACGACGCTGACTGCCCTGGAGGCCGCAGCCAACCCCGGCACTGC
   3361   ---------+---------+---------+---------+---------+---------+ 3420
          CAGCCTTCGAGGGCCCCTGCTGCGACTGACGGGACCTCCGGCGTCGGTTGGGCCGTGACG
```

CCTCAGACTTCAAGACCATCCTGGACTGATGGCCACCCGCCCACAGCCAGGCCGAGAGCA
    3421 ---------+---------+---------+---------+---------+---------+ 3480
         GGAGTCTGAAGTTCTGGTAGGACCTGACTACCGGTGGGCGGGTGTCGGTCCGGCTCTCGT a        P  Q  T  S  R  P  S  W  T  D  G  H  P  P  T  A  R  P  R  A   -
b         L  R  L  Q  D  H  P  G  L  M  A  T  R  P  Q  P  G  R  E  Q  -
c          S  D  F  K  T  I  L  D  *  W  P  P  A  H  S  Q  A  E  S  R -

GACACCAGCAGCCCTGTCACGCCGGGCTCTACGTCCCAGGGAGGGAGGGGCGGCCCACAC
    3481 ---------+---------+---------+---------+---------+---------+ 3540
         CTGTGGTCGTCGGGACAGTGCGGCCCGAGATGCAGGGTCCCTCCCTCCCCGCCGGGTGTG a        D  T  S  S  P  V  T  P  G  S  T  S  Q  G  G  R  G  G  P  H   -
b         T  P  A  A  L  S  R  R  A  L  R  P  R  E  G  G  A  A  H  T  -
c          H  Q  Q  P  C  H  A  G  L  Y  V  P  G  R  E  G  R  P  T  P -

CCAGGCCCGCACCGCTGGGAGTCTGAGGCCTGAGTGAGTGTTTGGCCGAGGCCTGCATGT
    3541 ---------+---------+---------+---------+---------+---------+ 3600
         GGTCCGGGCGTGGCGACCCTCAGACTCCGGACTCACTCACAAACCGGCTCCGGACGTACA a        P  G  P  H  R  W  E  S  E  A  *  V  S  V  W  P  R  P  A  C   -
b         Q  A  R  T  A  G  S  L  R  P  E  *  V  F  G  R  G  L  H  V  -
c          R  P  A  P  L  G  V  *  G  L  S  E  C  L  A  E  A  C  M  S -

CCGGCTGAAGGCTGAGTGTCCGGCTGAGGCCTGAGCGAGTGTCCAGCCAAGGGCTGAGTG
    3601 ---------+---------+---------+---------+---------+---------+ 3660
         GGCCGACTTCCGACTCACAGGCCGACTCCGGACTCGCTCACAGGTCGGTTCCCGACTCAC a        P  A  E  G  *  V  S  G  *  G  L  S  E  C  P  A  K  G  *  V   -
b         R  L  K  A  E  C  P  A  E  A  *  A  S  V  Q  P  R  A  E  C  -
c          G  *  R  L  S  V  R  L  R  P  E  R  V  S  S  Q  G  L  S  V -

TCCAGCACACCTGCCGTCTTCACTTCCCCACAGGCTGGCGCTCGGCTCCACCCCAGGGCC
    3661 ---------+---------+---------+---------+---------+---------+ 3720
         AGGTCGTGTGGACGGCAGAAGTGAAGGGGTGTCCGACCGCGAGCCGAGGTGGGGTCCCGG a        S  S  T  P  A  V  F  T  S  P  Q  A  G  A  R  L  H  P  R  A   -
b         P  A  H  L  P  S  S  L  P  H  R  L  A  L  G  S  T  P  G  P  -
c          Q  H  T  C  R  L  H  F  P  T  G  W  R  S  A  P  P  Q  G  Q -

AGCTTTTCCTCACCAGGAGCCCGGCTTCCACTCCCCACATAGGAATAGTCCATCCCCAGA
    3721 ---------+---------+---------+---------+---------+---------+ 3780
         TCGAAAAGGAGTGGTCCTCGGGCCGAAGGTGAGGGGTGTATCCTTATCAGGTAGGGGTCT a        S  F  S  S  P  G  A  R  L  P  L  P  T  *  E  *  S  I  P  R   -
b         A  F  P  H  Q  E  P  G  F  H  S  P  H  R  N  S  P  S  P  D  -
c          L  F  L  T  R  S  P  A  S  T  P  H  I  G  I  V  H  P  Q  I -

TTCGCCATTGTTCACCCCTCGCCCTGCCCTCCTTTGCCTTCCACCCCCACCATCCAGGTG
    3781 ---------+---------+---------+---------+---------+---------+ 3840
         AAGCGGTAACAAGTGGGGAGCGGGACGGGAGGAAACGGAAGGTGGGGGTGGTAGGTCCAC a        F  A  I  V  H  P  S  P  C  P  P  L  P  S  T  P  T  I  Q  V   -
b         S  P  L  F  T  P  R  P  A  L  L  C  L  P  P  P  P  S  R  W  -
c          R  H  C  S  P  L  A  L  P  S  F  A  F  H  P  H  H  P  G  G -

GAGACCCTGAGAAGGACCCTGGGAGCTCTGGGAATTTGGAGTGACCAAAGGTGTGCCCTG
    3841 ---------+---------+---------+---------+---------+---------+ 3900
         CTCTGGGACTCTTCCTGGGACCCTCGAGACCCTTAAACCTCACTGGTTTCCACACGGGAC
```

TACACAGGCGAGGACCCTGCACCTGGATGGGGGTCCCTGTGGGTCAAATTGGGGGGAGGT
   3901 ---------+---------+---------+---------+---------+---------+ 3960
        ATGTGTCCGCTCCTGGGACGTGGACCTACCCCCAGGGACACCCAGTTTAACCCCCCTCCA a    Y  T  G  E  D  P  A  P  G  W  G  S  L  W  V  K  L  G  G  G    -
b      T  Q  A  R  T  L  H  L  D  G  G  P  C  G  S  N  W  G  E  V  -
c        H  R  R  G  P  C  T  W  M  G  V  P  V  G  Q  I  G  G  R  C-

GCTGTGGGAGTAAAATACTGAATATATGAGTTTTTCAGTTTTGAAAAAAAAAAAAAAAAA
   3961 ---------+---------+---------+---------+---------+---------+ 4020
        CGACACCCTCATTTTATGACTTATATACTCAAAAAGTCAAAACTTTTTTTTTTTTTTTTT a    A  V  G  V  K  Y  *  I  Y  E  F  F  S  F  E  K  K  K  K  K    -
b      L  W  E  *  N  T  E  Y  M  S  F  S  V  L  K  K  K  K  K  K  -
c        C  G  S  K  I  L  N  I  *  V  F  Q  F  *  K  K  K  K  K  K-

AAAAAAAAA
   4021 --------- 4029
        TTTTTTTTT a    K  K  K    -
b      K  K     -
c        K  K   -
```

FIG. 72I

```
                                                                    1
                                                                    met
GCAGCGCTGCGTCCTGCTGCGCACGTGGGAAGCCCTGGCCCCGGCCACCCCGCG ATG 10
pro arg ala pro arg cys arg ala val arg ser leu leu arg ser
CCG CGC GCT CCC CGC TGC CGA GCC GTG CGC TCC CTG CTG CGC AGC 20                                  30
his tyr arg glu val leu pro leu ala thr phe val arg arg leu
CAC TAC CGC GAG GTG CTG CCG CTG GCC ACG TTC GTG CGG CGC CTG 40
gly pro gln gly trp arg leu val gln arg gly asp pro ala ala
GGG CCC CAG GGC TGG CGG CTG GTG CAG CGC GGG GAC CCG GCG GCT 50                                  60
phe arg ala leu val ala gln cys leu val cys val pro trp asp
TTC CGC GCG CTG GTG GCC CAG TGC CTG GTG TGC GTG CCC TGG GAC 70
ala arg pro pro pro ala ala pro ser phe arg gln val ser cys
GCA CGG CCG CCC CCC GCC GCC CCC TCC TTC CGC CAG GTG TCC TGC 80                                  90
leu lys glu leu val ala arg val leu gln arg leu cys glu arg
CTG AAG GAG CTG GTG GCC CGA GTG CTG CAG AGG CTG TGC GAG CGC 100
gly ala lys asn val leu ala phe gly phe ala leu leu asp gly
GGC GCG AAG AAC GTG CTG GCC TTC GGC TTC GCG CTG CTG GAC GGG 110                                 120
ala arg gly gly pro pro glu ala phe thr thr ser val arg ser
GCC CGC GGG GGC CCC CCC GAG GCC TTC ACC ACC AGC GTG CGC AGC 130
tyr leu pro asn thr val thr asp ala leu arg gly ser gly ala
TAC CTG CCC AAC ACG GTG ACC GAC GCA CTG CGG GGG AGC GGG GCG 140                                 150
trp gly leu leu leu arg arg val gly asp asp val leu val his
TGG GGG CTG CTG CTG CGC CGC GTG GGC GAC GAC GTG CTG GTT CAC 160
leu leu ala arg cys ala leu phe val leu val ala pro ser cys
CTG CTG GCA CGC TGC GCG CTC TTT GTG CTG GTG GCT CCC AGC TGC 170                                 180
ala tyr gln val cys gly pro pro leu tyr gln leu gly ala ala
GCC TAC CAG GTG TGC GGG CCG CCG CTG TAC CAG CTC GGC GCT GCC 190
thr gln ala arg pro pro pro his ala ser gly pro arg arg arg
ACT CAG GCC CGG CCC CCG CCA CAC GCT AGT GGA CCC CGA AGG CGT
```

*FIG. 74A*

```
                200                                               210
leu gly cys glu arg ala trp asn his ser val arg glu ala gly
CTG GGA TGC GAA CGG GCC TGG AAC CAT AGC GTC AGG GAG GCC GGG 220
val pro leu gly leu pro ala pro gly ala arg arg arg gly gly
GTC CCC CTG GGC CTG CCA GCC CCG GGT GCG AGG AGG CGC GGG GGC 230                                240
ser ala ser arg ser leu pro leu pro lys arg pro arg arg gly
AGT GCC AGC CGA AGT CTG CCG TTG CCC AAG AGG CCC AGG CGT GGC 250
ala ala pro glu pro glu arg thr pro val gly gln gly ser trp
GCT GCC CCT GAG CCG GAG CGG ACG CCC GTT GGG CAG GGG TCC TGG 260                                   270
ala his pro gly arg thr arg gly pro ser asp arg gly phe cys
GCC CAC CCG GGC AGG ACG CGT GGA CCG AGT GAC CGT GGT TTC TGT 280
val val ser pro ala arg pro ala glu glu ala thr ser leu glu
GTG GTG TCA CCT GCC AGA CCC GCC GAA GAA GCC ACC TCT TTG GAG
                290                                   300
gly ala leu ser gly thr arg his ser his pro ser val gly arg
GGT GCG CTC TCT GGC ACG CGC CAC TCC CAC CCA TCC GTG GGC CGC 310
gln his his ala gly pro pro ser thr ser arg pro pro arg pro
CAG CAC CAC GCG GGC CCC CCA TCC ACA TCG CGG CCA CCA CGT CCC 320                                   330
trp asp thr pro cys pro pro val tyr ala glu thr lys his phe
TGG GAC ACG CCT TGT CCC CCG GTG TAC GCC GAG ACC AAG CAC TTC 340
leu tyr ser ser gly asp lys glu gln leu arg pro ser phe leu
CTC TAC TCC TCA GGC GAC AAG GAG CAG CTG CGG CCC TCC TTC CTA 350                                   360
leu ser ser leu arg pro ser leu thr gly ala arg arg leu val
CTC AGC TCT CTG AGG CCC AGC CTG ACT GGC GCT CGG AGG CTC GTG 370
glu thr ile phe leu gly ser arg pro trp met pro gly thr pro
GAG ACC ATC TTT CTG GGT TCC AGG CCC TGG ATG CCA GGG ACT CCC 380                                   390
arg arg leu pro arg leu pro gln arg tyr trp gln met arg pro
CGC AGG TTG CCC CGC CTG CCC CAG CGC TAC TGG CAA ATG CGG CCC 400
leu phe leu glu leu leu gly asn his ala gln cys pro tyr gly
CTG TTT CTG GAG CTG CTT GGG AAC CAC GCG CAG TGC CCC TAC GGG 410                                   420
val leu leu lys thr his cys pro leu arg ala ala val thr pro
GTG CTC CTC AAG ACG CAC TGC CCG CTG CGA GCT GCG GTC ACC CCA
```

FIG. 74B

```
                                430
ala ala gly val cys ala arg glu lys pro gln gly ser val ala
GCA GCC GGT GTC TGT GCC CGG GAG AAG CCC CAG GGC TCT GTG GCG
            440                                 450
ala pro glu glu glu asp thr asp pro arg arg leu val gln leu
GCC CCC GAG GAG GAG GAC ACA GAC CCC CGT CGC CTG GTG CAG CTG
                            460
leu arg gln his ser ser pro trp gln val tyr gly phe val arg
CTC CGC CAG CAC AGC AGC CCC TGG CAG GTG TAC GGC TTC GTG CGG
            470                                 480
ala cys leu arg arg leu val pro pro gly leu trp gly ser arg
GCC TGC CTG CGC CGG CTG GTG CCC CCA GGC CTC TGG GGC TCC AGG
                            490
his asn glu arg arg phe leu arg asn thr lys lys phe ile ser
CAC AAC GAA CGC CGC TTC CTC AGG AAC ACC AAG AAG TTC ATC TCC
            500                                 510
leu gly lys his ala lys leu ser leu gln glu leu thr trp lys
CTG GGG AAG CAT GCC AAG CTC TCG CTG CAG GAG CTG ACG TGG AAG
                            520
met ser val arg asp cys ala trp leu arg arg ser pro gly val
ATG AGC GTG CGG GAC TGC GCT TGG CTG CGC AGG AGC CCA GGG GTT
            530                                 540
gly cys val pro ala ala glu his arg leu arg glu glu ile leu
GGC TGT GTT CCG GCC GCA GAG CAC CGT CTG CGT GAG GAG ATC CTG
                            55C
ala lys phe leu his trp leu met ser val tyr val val glu leu
GCC AAG TTC CTG CAC TGG CTG ATG AGT GTG TAC GTC GTC GAG CTG
            560                                 570
leu arg ser phe phe tyr val thr glu thr thr phe gln lys asn
CTC AGG TCT TTC TTT TAT GTC ACG GAG ACC ACG TTT CAA AAG AAC
                            580
arg leu phe phe tyr arg pro ser val trp ser lys leu gln ser
AGG CTC TTT TTC TAC CGG CCG AGT GTC TGG AGC AAG TTG CAA AGC
            590                                 600
ile gly ile arg gln his leu lys arg val gln leu arg glu leu
ATT GGA ATC AGA CAG CAC TTG AAG AGG GTG CAG CTG CGG GAG CTG
                            610
ser glu ala glu val arg gln his arg glu ala arg pro ala leu
TCG GAA GCA GAG GTC AGG CAG CAT CGG GAA GCC AGG CCC GCC CTG
            620                                 630
leu thr ser arg leu arg phe ile pro lys pro asp gly leu arg
CTG ACG TCC AGA CTC CGC TTC ATC CCC AAG CCT GAC GGG CTG CGG
                            640
pro ile val asn met asp tyr val val gly ala arg thr phe arg
CCG ATT GTG AAC ATG GAC TAC GTC GTG GGA GCC AGA ACG TTC CGC
```

FIG. 74C

```
              650                                           660
arg glu lys arg ala glu arg leu thr ser arg val lys ala leu
AGA GAA AAG AGG GCC GAG CGT CTC ACC TCG AGG GTG AAG GCA CTG 670
phe ser val leu asn tyr glu arg ala arg arg pro gly leu leu
TTC AGC GTG CTC AAC TAC GAG CGG GCG CGG CGC CCC GGC CTC CTG 680                                           690
gly ala ser val leu gly leu asp asp ile his arg ala trp arg
GGC GCC TCT GTG CTG GGC CTG GAC GAT ATC CAC AGG GCC TGG CGC 700
thr phe val leu arg val arg ala gln asp pro pro pro glu leu
ACC TTC GTG CTG CGT GTG CGG GCC CAG GAC CCG CCG CCT GAG CTG 710                                           720
tyr phe val lys val asp val thr gly ala tyr asp thr ile pro
TAC TTT GTC AAG GTG GAT GTG ACG GGC GCG TAC GAC ACC ATC CCC 730
gln asp arg leu thr glu val ile ala ser ile ile lys pro gln
CAG GAC AGG CTC ACG GAG GTC ATC GCC AGC ATC ATC AAA CCC CAG 740                                           750
asn thr tyr cys val arg arg tyr ala val val gln lys ala ala
AAC ACG TAC TGC GTG CGT CGG TAT GCC GTG GTC CAG AAG GCC GCC 760
his gly his val arg lys ala phe lys ser his val ser thr leu
CAT GGG CAC GTC CGC AAG GCC TTC AAG AGC CAC GTC TCT ACC TTG 770                                           780
thr asp leu gln pro tyr met arg gln phe val ala his leu gln
ACA GAC CTC CAG CCG TAC ATG CGA CAG TTC GTG GCT CAC CTG CAG 790
glu thr ser pro leu arg asp ala val val ile glu gln ser ser
GAG ACC AGC CCG CTG AGG GAT GCC GTC GTC ATC GAG CAG AGC TCC 800                                           810
ser leu asn glu ala ser ser gly leu phe asp val phe leu arg
TCC CTG AAT GAG GCC AGC AGT GGC CTC TTC GAC GTC TTC CTA CGC 820
phe met cys his his ala val arg ile arg gly lys ser tyr val
TTC ATG TGC CAC CAC GCC GTG CGC ATC AGG GGC AAG TCC TAC GTC 830                                           840
gln cys gln gly ile pro gln gly ser ile leu ser thr leu leu
CAG TGC CAG GGG ATC CCG CAG GGC TCC ATC CTC TCC ACG CTG CTC 850
cys ser leu cys tyr gly asp met glu asn lys leu phe ala gly
TGC AGC CTG TGC TAC GGC GAC ATG GAG AAC AAG CTG TTT GCG GGG 860                                           870
ile arg arg asp gly leu leu leu arg leu val asp asp phe leu
ATT CGG CGG GAC GGG CTG CTC CTG CGT TTG GTG GAT GAT TTC TTG
```

FIG. 74D

```
                                        880
leu val thr pro his leu thr his ala lys thr phe leu arg thr
TTG GTG ACA CCT CAC CTC ACC CAC GCG AAA ACC TTC CTC AGG ACC 890                                         900
leu val arg gly val pro glu tyr gly cys val val asn leu arg
CTG GTC CGA GGT GTC CCT GAG TAT GGC TGC GTG GTG AAC TTG CGG 910
lys thr val val asn phe pro val glu asp glu ala leu gly gly
AAG ACA GTG GTG AAC TTC CCT GTA GAA GAC GAG GCC CTG GGT GGC 920                                         930
thr ala phe val gln met pro ala his gly leu phe pro trp cys
ACG GCT TTT GTT CAG ATG CCG GCC CAC GGC CTA TTC CCC TGG TGC
                                940
gly leu leu leu asp thr arg thr leu glu val gln ser asp tyr
GGC CTG CTG CTG GAT ACC CGG ACC CTG GAG GTG CAG AGC GAC TAC 950                                         960
ser ser tyr ala arg thr ser ile arg ala ser val thr phe asn
TCC AGC TAT GCC CGG ACC TCC ATC AGA GCC AGT GTC ACC TTC AAC 970
arg gly phe lys ala gly arg asn met arg arg lys leu phe gly
CGC GGC TTC AAG GCT GGG AGG AAC ATG CGT CGC AAA CTC TTT GGG 980                                         990
val leu arg leu lys cys his ser leu phe leu asp leu gln val
GTC TTG CGG CTG AAG TGT CAC AGC CTG TTT CTG GAT TTG CAG GTG 1000
asn ser leu gln thr val cys thr asn ile tyr lys ile leu leu
AAC AGC CTC CAG ACG GTG TGC ACC AAC ATC TAC AAG ATC CTC CTG 1010                                        1020
leu gln ala tyr arg phe his ala cys val leu gln leu pro phe
CTG CAG GCG TAC AGG TTT CAC GCA TGT GTG CTG CAG CTC CCA TTT 1030
his gln gln val trp lys asn pro thr phe phe leu arg val ile
CAT CAG CAA GTT TGG AAG AAC CCC ACA TTT TTC CTG CGC GTC ATC 1040                                        1050
ser asp thr ala ser leu cys tyr ser ile leu lys ala lys asn
TCT GAC ACG GCC TCC CTC TGC TAC TCC ATC CTG AAA GCC AAG AAC 1060
ala gly met ser leu gly ala lys gly ala ala gly pro leu pro
GCA GGG ATG TCG CTG GGG GCC AAG GGC GCC GCC GGC CCT CTG CCC 1070                                        1080
ser glu ala val gln trp leu cys his gln ala phe leu leu lys
TCC GAG GCC GTG CAG TGG CTG TGC CAC CAA GCA TTC CTG CTC AAG 1090
leu thr arg his arg val thr tyr val pro leu leu gly ser leu
CTG ACT CGA CAC CGT GTC ACC TAC GTG CCA CTC CTG GGG TCA CTC
```

FIG. 74E

```
                1100                                              1110
arg thr ala gln thr gln leu ser arg lys leu pro gly thr thr
AGG ACA GCC CAG ACG CAG CTG AGT CGG AAG CTC CCG GGG ACG ACG 1120
leu thr ala leu glu ala ala ala asn pro ala leu pro ser asp
CTG ACT GCC CTG GAG GCC GCA GCC AAC CCG GCA CTG CCC TCA GAC 1130      1132
phe lys thr ile leu asp OP
TTC AAG ACC ATC CTG GAC TGA TGGCCACCCGCCCACAGCCAGGCCGAGAGCAGA

CACCAGCAGCCCTGTCACGCCGGGCTCTACGTCCCAGGGAGGGAGGGGCGGCCCACACCC

AGGCCCGCACCGCTGGGAGTCTGAGGCCTGAGTGAGTGTTTGGCCGAGGCCTGCATGTCC

GGCTGAAGGCTGAGTGTCCGGCTGAGGCCTGAGCGAGTGTCCAGCCAAGGGCTGAGTGTC

CAGCACACCTGCCGTCTTCACTTCCCCACAGGCTGGCGCTCGGCTCCACCCCAGGGCCAG

CTTTTCYTCACCAGGAGCCCGGCTTCCACTCCCCACATAGGAATAGTCCATCCCCAGATT

CGCCATTGTTCACCCYTCGCCCTGCCYTCCTTTGCCTTCCACCCCCACCATCCAGGTGGA

GACCCTGAGAAGGACCCTGGGAGCTCTGGGAATTTGGAGTGACCAAAGGTGTGCCCTGTA

CACAGGCGAGGACCCTGCACCTGGATGGGGGTCCCTGTGGGTCAAATTGGGGGGAGGTGC

TGTGGGAGTAAAATACTGAATATATGAGTTTTTCAGTTTTGRAAAAAAAAAAAAAAAAAA

AAAAAAAAA
```

FIG. 74F

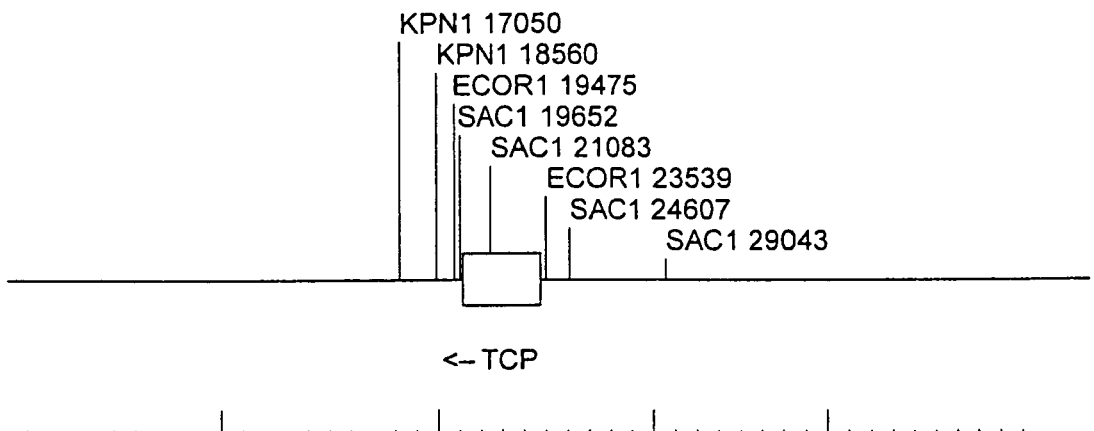

FIG. 75

NUCLEIC ACIDS ENCODING HUMAN TELOMERASE REVERSE TRANSCRIPTASE AND RELATED HOMOLOGS

This application is a continuation of U.S. patent application Ser. No. 08/974,549 filed Nov. 19, 1997, U.S. Pat. No. 6,166,178, which is a continuation-in-part application of U.S. patent application Ser. No. 08/915,503, filed Aug. 14, 1997, abandoned, and a continuation-in-part application of U.S. patent application Ser. No. 08/912,951, filed Aug. 14, 1997, U.S. Pat. No. 6,475,789 and a continuation-in-part of application of U.S. patent application Ser. No. 08/911,312, filed Aug. 14, 1997, abandoned, all three of which are continuations-in-part of U.S. patent application Ser. No. 08/854,050, filed May 9, 1997, U.S. Pat. No. 6,261,836, which is a continuation-in-part of U.S. patent application Ser. No. 08/851,843, filed May 6, 1997, U.S. Pat. No. 6,093,809, which is a continuation-in-part of U.S. patent application Ser. No. 08/846,017, filed Apr. 25, 1997, abandoned, which is a continuation-in-part of U.S. patent application Ser. No. 08/844,419, filed Apr. 18, 1997, abandoned. This application also claims priority to Patent Convention Treaty Patent Application Serial No.: PCT/US97/17885 (published on Apr. 9, 1998 as WO 98/14593) and to Patent Convention Treaty Patent Application Serial No.: PCT/US97/17618 (published on Apr. 9, 1998 as WO 98/14592), both designating the U.S. and filed in the U.S. Receiving Office on Oct. 1, 1997. Each of the aforementioned applications is explicitly incorporated herein by reference in its entirety and for all purposes. This application also incorporates by reference copending U.S. patent application Ser. No. 08/974,584, filed Nov. 19, 1997, in its entirety and for all purposes.

This invention was made with Government support under Grant No. GM28039, awarded by the National Institutes of Health. The Government has certain rights in this invention.

FIELD OF THE INVENTION

The present invention is related to novel nucleic acids encoding the catalytic subunit of telomerase and related polypeptides. In particular, the present invention is directed to the catalytic subunit of human telomerase. The invention provides methods and compositions relating to medicine, molecular biology, chemistry, pharmacology, and medical diagnostic and prognostic technology.

BACKGROUND OF THE INVENTION

The following discussion is intended to introduce the field of the present invention to the reader. The citation of various references in this section is not to be construed as an admission of prior invention.

It has long been recognized that complete replication of the ends of eukaryotic chromosomes requires specialized cell components (Watson, 1972, *Nature New Biol.*, 239:197; Olovnikov, 1973, *J. Theor. Biol.*, 41:181). Replication of a linear DNA strand by conventional DNA polymerases requires an RNA primer, and can proceed only 5' to 3'. When the RNA bound at the extreme 5' ends of eukaryotic chromosomal DNA strands is removed, a gap is introduced, leading to a progressive shortening of daughter strands with each round of replication. This shortening of telomeres, the protein-DNA structures physically located on the ends of chromosomes, is thought to account for the phenomenon of cellular senescence or aging (see, e.g., Goldstein, 1990, *Science* 249:1129; Martin et al., 1979, *Lab. Invest.* 23:86; Goldstein et al., 1969, *Proc. Natl. Acad. Sci. USA* 64:155; and Schneider and Mitsui, 1976, *Proc. Natl. Acad. Sci. USA*, 73:3584) of normal human somatic cells in vitro and in vivo.

The length and integrity of telomeres is thus related to entry of a cell into a senescent stage (i.e., loss of proliferative capacity). Moreover, the ability of a cell to maintain (or increase) telomere length may allow a cell to escape senescence, i.e., to become immortal.

The structure of telomeres and telomeric DNA has been investigated in numerous systems (see, e.g, Harley and Villeponteau, 1995, *Curr. Opin. Genet. Dev.* 5:249). In most organisms, telomeric DNA consists of a tandem array of very simple sequences; in humans and other vertebrates telomeric DNA consists of hundreds to thousands of tandem repeats of the sequence TTAGGG. Methods for determining and modulating telomere length in cells are described in PCT Publications WO 93/23572 and WO 96/41016.

The maintenance of telomeres is a function of a telomere-specific DNA polymerase known as telomerase. Telomerase is a ribonucleoprotein (RNP) that uses a portion of its RNA moiety as a template for telomere repeat DNA synthesis (Morin, 1997, *Eur. J. Cancer* 33:750; Yu et al., 1990, *Nature* 344:126; Singer and Gottschling, 1994, *Science* 266:404; Autexier and Greider, 1994, *Genes Develop.*, 8:563; Gilley et al., 1995, *Genes Develop.*, 9:2214; McEachern and Blackburn, 1995, *Nature* 367:403; Blackburn, 1992, *Ann. Rev. Biochem.*, 61:113; Greider, 1996, *Ann. Rev. Biochem.*, 65:337). The RNA components of human and other telomerases have been cloned and characterized (see, PCT Publication WO 96/01835 and Feng et al., 1995, *Science* 269: 1236). However, the characterization of the protein components of telomerase has been difficult. In part, this is because it has proved difficult to purify the telomerase RNP, which is present in extremely low levels in cells in which it is expressed. For example, it has been estimated that human cells known to express high levels of telomerase activity may have only about one hundred molecules of the enzyme per cell.

Consistent with the relationship of telomeres and telomerase to the proliferative capacity of a cell (i.e., the ability of the cell to divide indefinitely), telomerase activity is detected in immortal cell lines and an extraordinarily diverse set of tumor tissues, but is not detected (i.e., was absent or below the assay threshold) in normal somatic cell cultures or normal tissues adjacent to a tumor (see, U.S. Pat. Nos. 5,629,154; 5,489,508; 5,648,215; and 5,639,613; see also, Morin, 1989, *Cell* 59: 521; Shay and Bacchetti 1997, *Eur. J. Cancer* 33:787; Kim et al., 1994, *Science* 266:2011; Counter et al., 1992, *EMBO J.* 11:1921; Counter et al., 1994, *Proc. Natl. Acad. Sci. U.S.A.* 91, 2900; Counter et al., 1994, *J. Virol.* 68:3410). Moreover, a correlation between the level of telomerase activity in a tumor and the likely clinical outcome of the patient has been reported (e.g., U.S. Pat. No. 5,639,613, supra; Langford et al., 1997, *Hum. Pathol.* 28:416). Telomerase activity has also been detected in human germ cells, proliferating stem or progenitor cells, and activated lymphocytes. In somatic stem or progenitor cells, and in activated lymphocytes, telomerase activity is typically either very low or only transiently expressed (see, Chiu et al., 1996, *Stem Cells* 14:239; Bodnar et al., 1996, *Exp. Cell Res.* 228:58; Taylor et al., 1996, *J. Invest. Dermatology* 106: 759).

Human telomerase is an ideal target for diagnosing and treating human diseases relating to cellular proliferation and senescence, such as cancer. Methods for diagnosing and treating cancer and other telomerase-related diseases in humans are described in U.S. Pat. Nos. 5,489,508, 5,639, 613, and 5,645,986. Methods for predicting tumor progression by monitoring telomerase are described in U.S. Pat. No. 5,639,613. The discovery and characterization of the catalytic protein subunit of human telomerase would provide additional useful assays for telomerase and for disease diagnosis and therapy. Moreover, cloning and determination of the primary sequence of the catalytic protein subunit would allow more effective therapies for human cancers and other diseases related to cell proliferative capacity and senescence.

BRIEF SUMMARY OF THE INVENTION

The present invention provides an isolated, substantially pure, or recombinant protein preparation of a telomerase reverse transcriptase protein, or a variant thereof, or a fragment thereof. In one embodiment the protein is characterized as having a defined motif that has an amino acid sequence:

Trp-$R_1$-$X_7$-$R_1$-$R_1$-$R_2$-X-Phe-Phe-Tyr-X-Thr-Glu-$X_{8-9}$-$R_3$-$R_3$-Arg-$R_4$-$X_2$-Trp (SEQ ID NOS:11 and 12)

where X is any amino acid and a subscript refers to the number of consecutive residues, $R_1$ is leucine or isoleucine, $R_2$ is glutamine or arginine, $R_3$ is phenylalanine or tyrosine, and $R_4$ is lysine or histidine. In one embodiment the protein has a sequence of human TRT. In other embodiments, the invention relates to peptides and polypeptides sharing substantial sequence identity with a subsequence of such proteins.

In a related embodiment the invention provides an isolated, substantially pure or recombinant nucleic acid that encodes a telomerase reverse transcriptase protein. In one embodiment the nucleic acid encodes a protein comprising an amino acid sequence (SEQ ID NOS:11 and 12):

Trp-$R_1$-$X_7$-$R_1$-$R_1$-$R_2$-X-Phe-Phe-Tyr-X-Thr-Glu-$X_{8-9}$-$R_3$-$R_3$-Arg-$R_4$-$X_2$-Trp.

In another embodiment, the nucleic acid has a sequence that encodes the human TRT protein. In other embodiments, the invention relates to oligonucleotides and polynucleotides sharing substantial sequence identity or complementarity with a subsequence of such nucleic acids.

In one embodiment, the invention relates to human telomerase reverse transcriptase (hTRT) protein. Thus, in one embodiment, the invention provides an isolated, substantially pure, or recombinant protein preparation of an hTRT protein, or a variant thereof, or a fragment thereof. In one embodiment, the protein is characterized by having an amino acid sequence with at least about 75% or at least about 80% sequence identity to the hTRT protein of FIG. 17 (SEQ ID NO:2), or a variant thereof, or a fragment thereof. In a related aspect, the hTRT protein has the sequence of SEQ ID NO:2. In some embodiments, the protein has one or more telomerase activities, such as catalytic activity. In one embodiment, the hTRT protein fragment has at least 6 amino acid residues. In other embodiments, the hTRT protein fragment has at least 8, at least about 10, at least about 12, at least about 15 or at least about 20 contiguous amino acid residues of a naturally occurring hTRT polypeptide. In still other embodiments, the hTRT protein fragment has at least about 50 or at least about 100 amino acid residues.

The invention also provides a composition comprising an hTRT protein and an RNA. The RNA may be a telomerase RNA, such as a human telomerase RNA. In one embodiment, the hTRT protein and the human telomerase RNA (hTR) form a ribonucleoprotein complex with a telomerase activity.

In one embodiment, the invention provides isolated human telomerase comprising hTRT protein, such as a substantially pure human telomerase comprising hTRT protein and comprising hTR. In one embodiment, the telomerase is at least about 95% pure. The telomerase may be isolated from a cell, such as a recombinant host cell in or a cell that expresses telomerase activity.

In another aspect, the invention provides an isolated, synthetic, substantially pure, or recombinant polynucleotide comprising a nucleic acid sequence that encodes an hTRT protein. In one embodiment, the polynucleotide has a nucleotide sequence encoding an hTRT protein that has an amino acid sequence as set forth in FIG. 17 (SEQ ID NO:2) or a sequence that comprises one or more conservative amino acid (or codon) substitutions or one or more activity-altering amino acid (or codon) substitutions in said amino acid sequence. In a related aspect, the polynucleotide hybridizes under stringent conditions to a polynucleotide having the sequence as set forth in FIG. 16 (SEQ ID NO:1). In another related aspect, the nucleotide sequence of the polynucleotide has a smallest sum probability of less than about 0.5 when compared to a nucleotide sequence as set forth in FIG. 16 (SEQ ID NO:1) using BLAST algorithm with default parameters.

In another aspect, the invention provides a polynucleotide having a promoter sequence operably linked to the sequence encoding the hTRT protein. The promoter may be a promoter other than the naturally occurring hTRT promoter. In a related aspect, the invention provides an expression vector comprising the promoter of the hTRT.

The invention also provides an isolated, synthetic, substantially pure, or recombinant polynucleotide that is at least ten nucleotides in length and comprises a contiguous sequence of at least ten nucleotides that is identical or exactly complementary to a contiguous sequence in a naturally occurring hTRT gene or hTRT mRNA. In some embodiments the polynucleotide is an RNA, a DNA, or contains one or more non-naturally occurring, synthetic nucleotides. In one aspect, the polynucleotide is identical or exactly complementary to the contiguous sequence of at least ten contiguous nucleotides in a naturally occurring hTRT gene or hTRT mRNA. For example, the polynucleotide may be an antisense polynucleotide. In one embodiment, the antisense polynucleotide comprises at least about 20 nucleotides.

The invention further provides a method of preparing recombinant telomerase by contacting a recombinant hTRT protein with a telomerase RNA component under conditions such that said recombinant protein and said telomerase RNA component associate to form a telomerase enzyme capable of catalyzing the addition of nucleotides to a telomerase substrate. In one embodiment, the hTRT protein has a sequence as set forth in FIG. 17 (SEQ ID NO:2). The hTRT protein may be produced in an in vitro expression system and mixed with a telomerase RNA or, in another embodiment, the telomerase RNA can be co-expressed in the in vitro expression system. In one embodiment the telomerase RNA is hTR. In an alternative embodiment, the contacting occurs in a cell, such as a human cell. In one embodiment, the cell does not have telomerase activity prior to the contacting of the hTRT and the RNA, or the introduction, such as by transfection, of an hTRT polynucleotide. In one embodiment, the telomerase RNA is expressed naturally by said cell.

The invention also provides a cell, such as a human, mouse, or yeast cell, containing the recombinant polynucleotides of the invention such as a polynucleotide with an hTRT protein coding sequence operably linked a promoter. In particular aspects, the cell is a vertebrate cell, such as a cell from a mammal, for example a human, and has an increased proliferative capacity relative to a cell that is otherwise identical but does not comprise the recombinant polynucleotide or has an increased telomerase activity level relative to a cell that is otherwise identical but does not comprise the recombinant polynucleotide. In some embodiments the cell is immortal.

In related embodiments, the invention provides organisms and cells comprising a polynucleotide encoding a human telomerase reverse transcriptase polypeptide, such as a transgenic non-human organism such as a yeast, plant, bacterium, or a non-human animal, for example, a mouse. The invention also provides for transgenic animals and cells from which an hTRT gene has been deleted (knocked-out) or mutated such that the gene does =not express a naturally occurring hTRT gene product. Thus, in alternative embodiments, the transgenic non-human animal has a mutated telomerase gene, is an animal deficient in a telomerase activity, is an animal whose TRT deficiency is a result of a mutated gene encoding a TRT having a reduced level of a telomerase activity compared to a wild-type TRT and is an animal having a mutated TRT gene with one or more mutations, including missense mutations nonsense mutations, insertions, or deletions.

The invention also provides an isolated or recombinant antibody, or fragment thereof, that specifically binds to an hTRT protein. In one embodiment, the antibody binds with an affinity of at least about $10^8$ $M^{-1}$. The antibody may be a monoclonal or may be a polyclonal composition, such as a polyclonal antisera. In a related aspect, the invention provides a cell capable of secreting the antibody, such as a hybridoma.

The invention also provides a method for determining whether a compound or treatment is a modulator of a telomerase reverse transcriptase activity or hTRT expression. The method involves detecting or monitoring a change in activity or expression in a cell, animal or composition comprising an hTRT protein or polynucleotide following administration of the compound or treatment. In one embodiment, the method includes the steps of providing a TRT composition, contacting the TRT with the test compound and measuring the activity of the TRT, where a change in TRT activity in the presence of the test compound is an indicator that the test compound modulates TRT activity. In certain embodiments, the composition is a cell, an organism, a transgenic organism or an in vitro system, such as an expression system, which contains a recombinant polynucleotide encoding an hTRT polypeptide. Thus, the hTRT of the method may be a product of in vitro expression. In various embodiments the detection of telomerase activity or expression may be by detecting a change in abundance of an hTRT gene product, monitoring incorporation of a nucleotide label into a substrate for telomerase, monitoring hybridization of a probe to an extended telomerase substrate, monitoring amplification of an extended telomerase substrate, monitoring telomere length of a cell exposed to the test compound, monitoring the loss of the ability of the telomerase to bind to a chromosome, or measuring the accumulation or loss of telomere structure.

In one aspect, the invention provides a method of detecting an hTRT gene product in a biological sample by contacting the biological sample with a probe that specifically binds the gene product, wherein the probe and the gene product form a complex, and detecting the complex, where the presence of the complex is correlated with the presence of the hTRT gene product in the biological sample. The gene product may be RNA, DNA or a polypeptide. Examples of probes that may be used for detection include, but are not limited to, nucleic acids and antibodies.

In one embodiment, the gene product is a nucleic acid which is detected by amplifying the gene and detecting the amplification product, where the presence of the complex or amplification product is correlated with the presence of the hTRT gene-product in the biological sample.

In one embodiment, the biological sample is from a patient, such as a human patient. In another embodiment the biological sample includes at least one cell from an in vitro cell culture, such as a human cell culture.

The invention further provides a method of detecting the presence of at least one immortal or telomerase positive human cell in a biological sample comprising human cells by obtaining the biological sample comprising human cells; and detecting the presence in the sample of a cell having a high level of an hTRT gene product, where the presence of a cell having a high level of the hTRT gene product is correlated with the presence of immortal or telomerase positive cells in the biological sample.

The invention also provides a method for diagnosing a telomerase-related condition in a patient by obtaining a cell or tissue sample from the patient, determining the amount of an hTRT gene product in the cell or tissue; and comparing the amount of hTRT gene product in the cell or tissue with the amount in a healthy cell or tissue of the same type, where a different amount of hTRT gene product in the sample from the patient and the healthy cell or tissue is diagnostic of a telomerase-related condition. In one embodiment the telomerase-related condition is cancer and a greater amount of hTRT gene product is detected in the sample.

The invention further provides a method of diagnosing cancer in a patient by obtaining a biological sample from the patient, and detecting a hTRT gene product in the patient sample, where the detection of the hTRT gene product in the sample is correlated with a diagnosis of cancer.

The invention further provides a method of diagnosing cancer in a patient by obtaining a patient sample, determining the amount of hTRT gene product in the patient sample; and comparing the amount of hTRT gene product with a normal or control value, where an amount of the hTRT gene product in the patient that is greater than the normal or control value is diagnostic of cancer.

The invention also provides a method of diagnosing cancer in a patient, by obtaining a patient sample containing at least one cell; determining the amount of an hTRT gene product in a cell in the sample; and comparing the amount of hTRT gene product in the cell with a normal value for the cell, wherein an amount of the hTRT gene product greater than the normal value is diagnostic of cancer. In one embodiment, the sample is believed to contain at least one malignant cell.

The invention also provides a method for a prognosing a cancer patient by determining the amount of hTRT gene product in a cancer cell obtained from the patient; and comparing the amount of hTRT in the cancer cell with a prognostic value of hTRT consistent with a prognosis for the cancer; where an amount of hTRT in the sample that is at the prognostic value provides the particular prognosis.

The invention also provides a method for monitoring the ability of an anticancer treatment to reduce the proliferative capacity of cancer cells in a patient, by making a first measurement of the amount of an hTRT gene product in at least one cancer cell from the patient; making a second measurement of the level of the hTRT gene product in at least one cancer cell from the patient, wherein the anticancer treatment is administered to the patient before the second measurement; and comparing the first and second measurements, where a lower level of the hTRT gene product in the second measurement is correlated with the ability of an anticancer treatment to reduce the proliferative capacity of cancer cells in the patient.

The invention also provides kits for the detection of an hTRT gene or gene product. In one embodiment, the kit includes a container including a molecule selected from an hTRT nucleic acid or subsequence thereof, an hTRT polypeptide or subsequence thereof, and an anti-hTRT antibody.

The invention also provides methods of treating human diseases. In one embodiment, the invention provides a method for increasing the proliferative capacity of a vertebrate cell, such as a mammalian cell, by introducing a recombinant polynucleotide into the cell, wherein said polynucleotide comprises a sequence encoding an hTRT polypeptide. In one embodiment, the hTRT polypeptide has a sequence as shown in FIG. 17. In one embodiment, the sequence is operably linked to a promoter. In one embodiment, the hTRT has telomerase catalytic activity. In one embodiment, the cell is human, such as a cell in a human patient. In an alternative embodiment, the cell is cultured in vitro. In a related embodiment, the cell is introduced into a human patient.

The invention further provides a method for treating a human disease by introducing recombinant hTRT polynucleotide into at least one cell in a patient. In one embodiment, a gene therapy vector is used. In a related embodiment, the method further consists of introducing into the cell a polynucleotide comprising a sequence encoding hTR, for example, an hTR polynucleotide operably linked to a promoter.

The invention also provides a method for increasing the proliferative capacity of a vertebrate cell, said method comprising introducing into the cell an effective amount of hTRT polypeptide. In one embodiment the hTRT polypeptide has telomerase catalytic activity. The invention further provides cells and cell progeny with increased proliferative capacity.

The invention also provides a method for treating a condition associated with an elevated level of telomerase activity within a cell, comprising introducing into said cell a therapeutically effective amount of an inhibitor of said telomerase activity, wherein said inhibitor is an hTRT polypeptide or an hTRT polynucleotide. In one embodiment, the inhibitor is a polypeptide or polynucleotide comprising, e.g., at least a subsequence of a sequence shown in FIGS. 16, 17, or 20. In additional embodiments, the polypeptide or polynucleotide inhibits a TRT activity, such as binding of endogenous TRT to telomerase RNA.

The invention also provides a vaccine comprising an hTRT polypeptide and an adjuvant. The invention also provides pharmacological compositions containing a pharmaceutically acceptable carrier and a molecule selected from: an hTRT polypeptide, a polynucleotide encoding an hTRT polypeptide, and an hTRT nucleic acid or subsequence thereof.

DESCRIPTION OF THE FIGURES

FIG. 1 shows highly conserved residues in TRT motifs from human (SEQ ID NO:13), *S. pombe* (tez1) (SEQ ID NO:14), *S. cerevisiae* (EST2) (SEQ ID NO:15) and *Euplotes aediculatus* (p123) (SEQ ID NO:16). Identical amino acids are indicated with an asterisk (*) [raised slightly], while the similar amino acid residues are indicated by a dot (•). Motif "0" in the figure is also called Motif T; Motif "3" is also called Motif A.

FIG. 4 shows multiple sequence alignment of telomerase RTs (Sp_Trt1p, *S. pombe* TRT (SEQ ID NOS:24-29) [also referred to herein as "tez1p"]; hTRT, human TRT (SEQ ID NOS:30-35); Ea_p123, *Euplotes* p123 (SEQ ID NOS:36-41); Sc_Est2p, *S. cerevisiae* Est2p) (SEQ ID NOS:42-48) and members of other RT families (Sc_al, cytochrome oxidase group II intron 1-encoded protein from *S. cerevisiae* mitochondria (SEQ ID NOS:51-56), Dm_TART, reverse transcriptase from *Drosophila melanogaster* TART non-LTR retrotransposable element) (SEQ ID NOS:57-63; HIV-1, human immunodeficiency virus reverse transcriptase (SEQ ID NOS:64-68)). TRT con (SEQ ID NOS:17-23) and RT con (SEQ ID NOS:49 and 50) represent consensus sequences for telomerase RTs and non-telomerase RTs. Amino acids are designated with an h, hydrophobic; p, polar; c, charged. Triangles show residues that are conserved among telomerase proteins but different in other RTs. The solid line below motif E highlights the primer grip region.

FIG. 9 shows the construction of a hTRT promoter-reporter plasmid.

FIG. 11, in two pages, shows an alignment of sequences from four TRT proteins from human (hTRT; SEQ ID NOS: 72-79), *S. pombe* Trt1 (spTRT; SEQ ID NOS:80-87), *Euplotes* p123 (Ea_p123; SEQ ID NOS:88-95), and *S. cerevisiae* EST2p TRT (Sc_Est2; SEQ ID NOS:96-104) and identifies motifs of interest. TRT con (SEQ ID NOS:69, 21, 70 and 71) shows a TRT consensus sequence. RT con (SEQ ID NOS:49 and 50) shows consensus residues for other reverse transcriptases. Consensus residues in upper case indicate absolute conservation in TRT proteins.

FIG. 12 shows a Topoisomerase II cleavage site (SEQ ID NO: 108) and NFkB binding site motifs (NFkB_CS1=SEQ ID NO:105; NFkB-MHC-I.2=SEQ ID NO:106; NFkB_CS2=SEQ ID NO:107) in an hTRT intron, with the sequence shown corresponding to SEQ ID NO:7.

FIGS. 13A and 13B show the sequence of the DNA encoding the *Euplotes* 123 kDa telomerase protein subunit (*Euplotes* TRT; SEQ ID NO:109).

FIG. 14 shows the amino acid sequence of the *Euplotes* 123 kDa telomerase protein subunit (*Euplotes* TRT protein; SEQ ID NO:110).

FIGS. 15A-15F show the DNA (SEQ ID NO:111) and amino acid (SEQ ID NO:112) sequences of the *S. pombe* telomerase catalytic subunit (*S. pombe* TRT).

FIG. 16, in two pages, shows the hTRT cDNA sequence, with the sequence shown corresponding to SEQ ID NO:1.

FIG. 17 shows the hTRT protein encoded by the cDNA of FIG. 16. The protein sequence shown corresponds to SEQ ID NO:2.

FIG. 18 shows the sequence of clone 712562, with the sequence shown corresponding to SEQ ID NO:3.

FIG. 19 shows a 259 residue protein encoded by clone 712562, with the sequence shown corresponding to SEQ ID NO:10.

FIGS. 20A-20E show the sequence of a nucleic acid with an open reading frame encoding a Δ182 variant polypeptide, with the sequence shown corresponding to SEQ ID NO:4. This Figure also shows the amino acid sequence of this Δ182 variant polypeptide, with the amino acid sequence shown corresponding to SEQ ID NO:5.

FIGS. 21A-21E show sequence from an hTRT genomic clone, with the sequence shown corresponding to SEQ ID NO:6. Consensus motifs and elements are indicated, including sequences characteristic of a topoisomerase II cleavage site, NFκB binding sites, an Alu sequence and other sequence elements.

FIG. 23 shows the sequence of EST AA281296, corresponding to SEQ ID NO:8.

FIG. 24 shows the sequence of the 182 basepairs deleted in clone 712562, with the sequence shown corresponding to SEQ ID NO:9.

FIG. 26 is a schematic diagram of the affinity purification of telomerase showing the binding and displacement elution steps.

FIG. 32 shows the putative alignments of telomerase RNA template (SEQ ID NO:113), and hairpin primers with telomerase RNA.

FIG. 34 shows the DNA sequence of the gene encoding the 43 kDa telomerase protein subunit from *Euplotes* (SEQ ID NO:115).

FIGS. 35A-35D show the DNA sequence (SEQ ID NO:115), as well as the amino acid sequences of all three open reading frames of the 43 kDa telomerase protein subunit from *Euplotes* (a=SEQ ID NOS:116-140; b=SEQ ID NOS:141-162; c=SEQ ID NO:163-186).

FIGS. 36A and 36B show a sequence comparison between the 123 kDa telomerase protein subunit of *Euplotes* (SEQ ID NO:187) (upper sequence) and the 80 kDa polypeptide subunit of *T. thermophila* (SEQ ID NO:188) (lower sequence).

FIGS. 37A and 37B show a sequence comparison between the 123 kDa telomerase protein subunit of *E. aediculatus* (SEQ ID NO:189) (upper sequence) and the 95 kDa telomerase polypeptide of *T. thermophila* (SEQ ID NO:190) (lower sequence).

FIG. 38 shows the best-fit alignment between a portion of the "La-domain" of the 43 kDa telomerase protein subunit of *E. aediculatus* (SEQ ID NO:191) (upper sequence) and a portion of the 95 kDa polypeptide subunit of *T. thermophila* (SEQ ID NO:192) (lower sequence).

FIG. 39 shows the best-fit alignment between a portion of the "La-domain" of the 43 kDa telomerase protein subunit of *E. aediculatus* (SEQ ID NO:193) (upper sequence) and a portion of the 80 kDa polypeptide subunit of *T. thermophila* (SEQ ID NO:194) (lower sequence).

FIG. 40 shows the alignment and motifs of the polymerase domain of the 123 kDa telomerase protein subunit of *E. aediculatus* (SEQ ID NOS:38-41) and the polymerase domains of various reverse transcriptases including a cytochrome oxidase group II intron 1-encoded protein from *S. cerevisiae* mitochondria (al S.c. (group II)) (SEQ ID NOS: 204, 205, 54, 206, and 56), Dong (LINE) (SEQ ID NOS: 200-203), and yeast ESTp (L8543.12) (SEQ ID NOS:45, 46, 211 and 212), HIV-RT (SEQ ID NOS:207-210) and consensus (SEQ ID NOS:195-199).

FIG. 41 shows the alignment of a domain of the 43 kDa telomerase protein subunit (SEQ ID NO:213) with various La proteins (human La=SEQ ID NO:214; *Xenopus* LaA=SEQ ID NO:215; *Drosophila* La=SEQ ID NO:216; S.c. Lhp1p =SEQ ID NO:217).

FIG. 42 shows the nucleotide sequence encoding the *T. thermophila* 80 kDa protein subunit.

FIG. 43 shows the amino acid sequence of the *T. thermophila* 80 kDa protein subunit (SEQ ID NO:219).

FIG. 44 shows the nucleotide sequence encoding the *T. thermophila* 95kDa protein subunit (SEQ ID NO:220).

FIG. 45 shows the amino acid sequence of the *T. thermophila* 95 kDa protein subunit (SEQ ID NO:221).

FIG. 46 shows the amino acid sequence of L8543.12 ("Est2p") (SEQ ID NO:222).

FIG. 47 shows the alignment of the amino acid sequence encoded by the *Oxytricha* PCR product (SEQ ID NO:223) with the *Euplotes* p123 sequence (SEQ ID NO:224).

FIG. 48 shows the DNA sequence of Est2 (SEQ ID NO:225).

FIG. 49 shows partial amino acid sequence from a cDNA clone encoding human telomerase peptide motifs (SEQ ID NO:13).

FIG. 50 shows partial DNA sequence of a cDNA clone encoding human telomerase peptide motifs (SEQ ID NO:8).

FIG. 51 shows the amino acid sequence of tez1, also called *S. pombe* trt (SEQ ID NO:112).

FIGS. 52A and 52B show the DNA sequence of tez1 (SEQ ID NO:111). Intronic and other non-coding regions are shown in lower case and exons (i.e., coding regions) are shown in upper case.

FIG. 53 shows the alignment of EST2p (SEQ ID NO:226), *Euplotes* (SEQ ID NO:227), and *Tetrahymena* SEQ ID NO:228) sequences, as well as consensus sequence (SEQ ID NOS:229-231).

FIG. 54 shows the sequences of peptides (SEQ ID NOS: 232-237) useful for production of anti-hTRT antibodies.

FIG. 56 shows two degenerate primers (SEQ ID NOS:238 and 241) used in PCR to identify the *S. pombe* homolog of the *E. aediculatus* p123 sequences (SEQ ID NOS:239 and 240).

FIGS. 58A and 58B show the alignment of the M2 PCR product (SEQ ID NO:243) with *E. aediculatus* p123 (SEQ ID NO:242), *S. cerevisiae* (SEQ ID NO:244), and *Oxytricha* (SEQ ID NO:223) telomerase protein sequences. Also shown are the actual genomic sequences (SEQ ID NOS:246 and 249) and the peptides encoded (SEQ ID NOS:245 and 250), degenerate primers Poly4 (SEQ ID NO:238) and Poly 1 (SEQ ID NO:244), and homologous regions of the M2 PCR product (SEQ ID NO:247) and its encoded peptide region (SEQ ID NO:248).

FIG. 60 shows characteristics of the libraries used to screen for *S. pombe* telomerase protein sequences and shows the results of screening the libraries for *S. pombe* telomerase protein sequences.

FIG. 63 shows the alignment of RT domains from telomerase catalytic subunits for *S. pombe* (S.p.) (SEQ ID NOS: 251-255), *S. cerevisiae* (S.c.) (SEQ ID NOS:256-260) and *E. aediculatus* (E.a.) (SEQ ID NOS:261-265). Consensus sequences =SEQ ID NOS:49 and 50.

FIGS. 64A-64J show the alignment of the sequences from *Euplotes* ("Ea_p123") (SEQ ID NO:110), *S. cerevisiae* ("Sc_Est2p") (SEQ ID NO:222), and *S. pombe* ("SP_Tlp1p") (SEQ ID NO:112). In Panel A, the shaded areas indicate residues shared between two sequences. In Panel B, the shaded areas indicate residues shared between all three sequences.

FIGS. 68A-68C show the DNA (SEQ ID NO:266) and amino acid (SEQ ID NO:267) of the ORF encoding an approximately 63 kDa telomerase protein encoded by the EcoRI-NotI insert of clone 712562.

FIG. 69 shows an alignment of reverse transcriptase motifs from various sources, *E aediculatus* p123 (SEQ ID NOS:268-273), *S pombe* tez1 (SEQ ID NOS:274-279), *S.* *cerevisiae* EST2 (SEQ ID NOS:280-285), and human Hs TCP1 (SEQ ID NOS:286-291), with various consensus residues and motif sequences (SEQ ID NOS:49 and 50) indicated.

FIGS. 71A and 71B show the results of preliminary nucleic acid sequencing analysis of a hTRT cDNA sequence (SEQ ID NO:292).

FIGS. 72A-72I show the preliminary nucleic acid sequence of hTRT (SEQ ID NO:292) and deduced ORF sequences in three reading frames (a=SEQ ID NOS:293-320; b=SEQ ID NOS:321-333; c=SEQ ID NOS:334-342).

FIGS. 74A-74F show refined nucleic acid sequence (SEQ ID NO:343) and deduced ORF sequences (SEQ ID NO:344) of hTRT.

FIG. 75 shows a restriction map of lambda clone 25-1.1.

DETAILED DESCRIPTION OF THE INVENTION

I. Introduction

Figure 2:
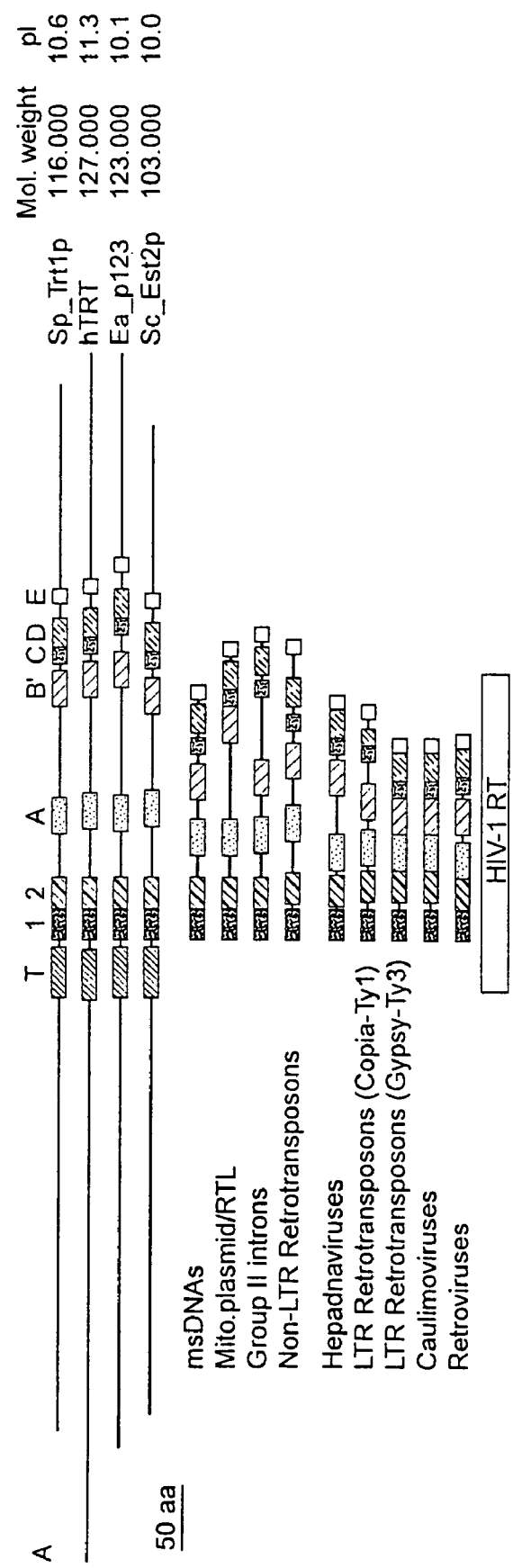
FIG. 2 shows the location of telomerase-specific and RT-specific sequence motifs of telomerase proteins and other reverse transcriptases. Locations of telomerase-specific motif T and conserved RT motifs 1, 2 and A-E are indicated by boxes. The open rectangle labeled HIV-1 RT delineates the portion of this protein shown in FIG. 3.

Telomerase is a ribonucleoprotein complex (RNP) comprising an RNA component and a catalytic protein component. The present invention relates to the cloning and characterization of the catalytic protein component of telomerase, hereinafter referred to as "TRT" (telomerase reverse transcriptase). TRT is so named because this protein acts as an RNA-dependent DNA polymerase (reverse transcriptase), using the telomerase RNA component (hereinafter, "TR") to direct synthesis of telomere DNA repeat sequences. Moreover, TRT is evolutionarily related to other reverse transcriptases (see Example 12).

In one aspect, the present invention relates to the cloning and characterization of the catalytic protein component of human telomerase, hereinafter referred to as "hTRT." Human TRT is of extraordinary interest and value because, as noted supra, telomerase activity in human (and other mammalian cells) correlates with cell proliferative capacity, cell immortality, and the development of a neoplastic phenotype. For example, telomerase activity, and, as demonstrated in Example 2, infra, levels of human TRT gene products and are elevated in immortal human cells (such as malignant tumor cells and immortal cell lines) relative to mortal cells (such as most human somatic cells).

The present invention further provides methods and compositions valuable for diagnosis, prognosis, and treatment of human diseases and disease conditions, as described in some detail infra. Also provided are methods and reagents useful for immortalizing cells (in vivo and ex vivo), producing transgenic animals with desirable characteristics, and numerous other uses, many of which are described infra. The invention also provides methods and reagents useful for preparing, cloning, or re-cloning TRT genes and proteins from ciliates, fungi, vertebrates, such as mammals, and other organisms.

As described in detail infra, TRT was initially characterized following purification of telomerase from the ciliate *Euplotes aediculatus*. Extensive purification of *E. aediculatus* telomerase, using RNA-affinity chromatography and other methods, yielded the protein Ap123". Surprisingly, p123 is unrelated to proteins previously believed to constitute the protein subunits of the telomerase holoenzyme (i.e., the p80 and p95 proteins of *Tetrahymena thermophila*).

Analysis of the p123 DNA and protein sequences (Genbank Accession No. U95964; FIGS. 13 and 14) revealed reverse transcriptase (RT) motifs consistent with the role of p123 as the catalytic subunit of telomerase (see, e.g., FIGS. 1, 4 and 11). Moreover, p123 is related to a *S. cerevisiae* (yeast) protein, Est2p, which was known to play a role in maintenance of telomeres in *S. cerevisiae* (Genbank Accession No. S5396), but prior to the present invention was not recognized as encoding a telomerase catalytic subunit protein (see, e.g., Lendvay et al., 1996, *Genetics*, 144:1399).

In one aspect, the present invention provides reagents and methods for identifying and cloning novel TRTs using: nucleic acid probes and primers generated or derived from the TRT polynucleotides disclosed (e.g., for cloning TRT genes and cDNAs); antibodies that specifically recognize the motifs or motif sequences or other TRT epitopes (e.g., for expression cloning TRT genes or purification of TRT proteins); by screening computer databases; or other means. For example, as described in Example 1, PCR (polymerase chain reaction) amplification of *S. pombe* DNA was carried out with degenerate-sequence primers designed from the *Euplotes* p123 RT motifs B' and C. Of four prominent products generated, one encoded a peptide sequence homologous to *Euplotes* p123 and *S. cerevisiae* Est2p. Using this PCR product as a probe, the complete sequence of the *S. pombe* TRT homologue was obtained by screening of *S. pombe* cDNA and genomic libraries and amplifying *S. pombe* RNA by reverse transcription and PCR (RT-PCR). The complete sequence of the *S. pombe* gene ("trt1"; GenBank Accession No. AF015783; FIG. 15) revealed that homology with p123 and Est2p was especially high in the reverse transcriptase motifs. *S. pombe* trt1 is also referred to as tez1.

Amplification using degenerate primers derived from the telomerase RT motifs was also used to obtain TRT gene sequences in *Oxytricha trifallax* and *Tetrahymena thermophila*, as described in Example 1.

The *Euplotes* p123, *S. pombe* trt1, and *S. cerevisiae* Est2p nucleic acid sequences of the invention were used in a search of a computerized database of human expressed sequence tags (ESTs) using the program BLAST (Altschul et al. al, 1990, *J. Mol. Biol.* 215:403). Searching this database with the Est2p sequence did not indicate a match, but searching with p123 and trt1 sequences identified a human EST (Genbank accession no. AA281296; see SEQ ID NO:8), as described in Example 1, putatively encoding a homologous protein. Complete sequencing of the cDNA clone containing the EST (hereinafter, "clone 712562"; see SEQ ID NO:3) showed that seven RT motifs were present. However, this clone did not encode a contiguous human TRT with all seven motifs, because motifs B', C, D, and E were contained in a different open reading frame (ORF) than the more $NH_2$-terminal motifs. In addition, the distance between motifs A and B' was substantially shorter than that of the three previously characterized TRTs. Clone 712562 was obtained from the I.M.A.G.E. Consortium; Lennon et al., 1996, *Genomics* 33:151.

A cDNA clone, pGRN121, encoding a functional hTRT (see FIG. 16, SEQ ID NO:1) was isolated from a cDNA library derived from the human 293 cell line as described in Example 1. Comparing clone 712562 with pGRN121 showed that clone 712562 has a 182 base pair (see FIG. 24, SEQ ID NO:9) deletion between motifs A and B. The additional 182 base pairs present in pGRN121 place all of the TRT motifs in a single open reading frame, and increase the spacing between the motif A and motif B' regions to a distance consistent with the other known TRTs. As is described infra in the Examples (e.g., Example 7), SEQ ID NO:1 encodes a catalytically active telomerase protein having the sequence of SEQ ID NO:2. The polypeptide of SEQ ID NO:2 has 1132 residues and a calculated molecular weight of about 127 kilodaltons (kD).

As is discussed infra, and described in Example 9, infra, TRT cDNAs possessing the 182 basepair deletion characteristic of the clone 712562 are detected following reverse transcription of RNA from telomerase-positive cells (e.g., testis and 293 cells). hTRT RNAs lacking this 182 base pair sequence are referred to generally as "Δ182 variants" and may represent one, two, or several species. Although the hTRT variants lacking the 182 basepair sequence found in the pGRN121 cDNA are unlikely to encode a fully active telomerase catalytic enzyme, they may play a role in telomerase regulation, as discussed infra, and/or have partial telomerase activity, such as telomere binding or hTR binding activity, as discussed infra.

Thus, in one aspect, the present invention provides an isolated polynucleotide with a sequence of a naturally occurring human TRT gene or mRNA including, but not limited to, a polynucleotide having the sequence as set forth in FIG. 16 (SEQ ID NO:1). In a related aspect, the invention provides a polynucleotide encoding an hTRT protein, fragment, variant or derivative. In another related aspect, the invention provides sense and antisense nucleic acids that bind to an hTRT gene or mRNA. The invention further provides hTRT proteins, whether synthesized or purified from natural sources, as well as antibodies and other agents that specifically bind an hTRT protein or a fragment thereof. The present invention also provides many novel methods, including methods that employ the aforementioned compositions, for example, by providing diagnostic and prognostic assays for human diseases, methods for developing therapeutics and methods of therapy, identification of telomerase-associated proteins, and methods for screening for agents capable of activating or inhibiting telomerase activity. Numerous other aspects and embodiments of the invention are provided infra.

One aspect of the invention is the use of a polynucleotide that is at least ten nucleotides to about 10 kb or more in length and comprises a contiguous sequence of at least ten nucleotides that is identical or exactly complementary to a contiguous sequence in a naturally occurring hTRT gene or hTRT mRNA in assaying or screening for an hTRT gene sequence or hTRT mRNA, or in preparing a recombinant host cell.

A further aspect of the invention is the use of an agent increasing expression of hTRT in the manufacture of a medicament for the treatment of a condition addressed by increasing proliferative capacity of a vertebrate cell, optionally the medicament being for inhibiting the effects of aging.

Yet a further aspect of the invention is the use of an inhibitor of telomerase activity in the manufacture of a medicament for the treatment of a condition associated with an elevated level of telomerase activity within a human cell.

The proteins, variants and fragments of the invention, and the encoding polynucleotides or fragments, are also each provided in a further aspect of this invention for use as a pharmaceutical.

The invention further includes the use of a protein, variant or fragment, or of a polynucleotide or fragment, in each case as defined herein, in the manufacture of a medicament, for example in the manufacture of a medicament for inhibiting an effect of aging or cancer.

Another aspect of the invention is a polynucleotide selected from:

(a) the DNA having a sequence as set forth in FIG. 16;

(b) a polynucleotide of at least 10 nucleotides which hybridizes to the foregoing DNA and which codes for an hTRT protein or variant or which hybridizes to a coding sequence for such a variant; and, (c) DNA sequences which are degenerate as a result of the genetic code to the DNA sequences defined in (a) and (b) and which code for an hTRT polypeptide or variant.

In certain embodiments of the present invention, the hTRT polynucleotides are other than the 389 nucleotide polynucleotide of SEQ ID NO:8 and/or other than clone 712562, the plasmid containing an insert, the sequence of which insert is shown in FIG. 18 (SEQ ID NO:3).

The description below is organized by topic. Part II further describes amino acid motifs characteristic of TRT proteins, as well as TRT genes encoding proteins having such motifs. Parts III-VI describe, inter alia, nucleic acids, proteins, antibodies and purified compositions of the invention with particular focus on human TRT related compositions. Part VI describes, inter alia, methods and compositions of the invention useful for treatment of human disease. Part VIII describes production and identification of immortalized human cell lines. Part IX describes, inter alia, uses of the nucleic acids, polynucleotides, and other compositions of the invention for diagnosis of human diseases. Part X describes, inter alia, methods and compositions of the invention useful for screening and identifying agents and treatments that modulate (e.g., inhibit or promote) telomerase activity or expression. Part XI describes, inter alia, transgenic animals (e.g., telomerase knockout animals and cells). Part XII is a glossary of terms used in Parts I-XI. Part XIII describes examples relating to specific embodiments of the invention. The organization of the description of the invention by topic and subtopic is to provide clarity, and not to be limiting in any way.

II. TRT GENES AND PROTEINS

The present invention provides isolated and/or recombinant genes and proteins having a sequence of a telomerase catalytic subunit protein (i.e., telomerase reverse transcriptase), including, but not limited to, the naturally occurring forms of such genes and proteins in isolated or recombinant form. Typically, TRTs are large, basic, proteins having reverse transcriptase (RT) and telomerase-specific (T) amino acid motifs, as disclosed herein. Because these motifs are conserved across diverse organisms, TRT genes of numerous organisms may be obtained using the methods of the invention or identified using primers, nucleic acid probes, and antibodies of the invention, such as those specific for one or more of the motif sequences.

Figure 3:
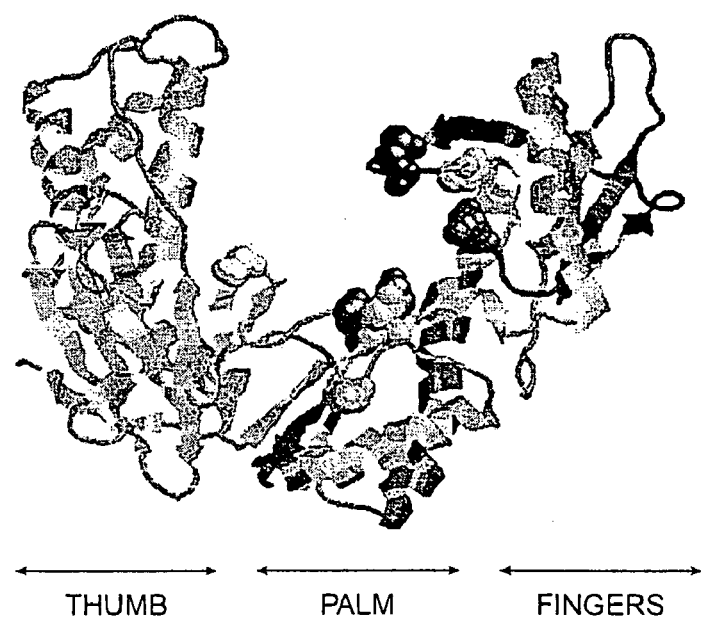
FIG. 3 shows the crystal structure of the p66 subunit of HIV-1 reverse transcriptase (Brookhaven code 1HNV). The view is from the back of the right hand to enable all motifs to be shown.
Figure 4:
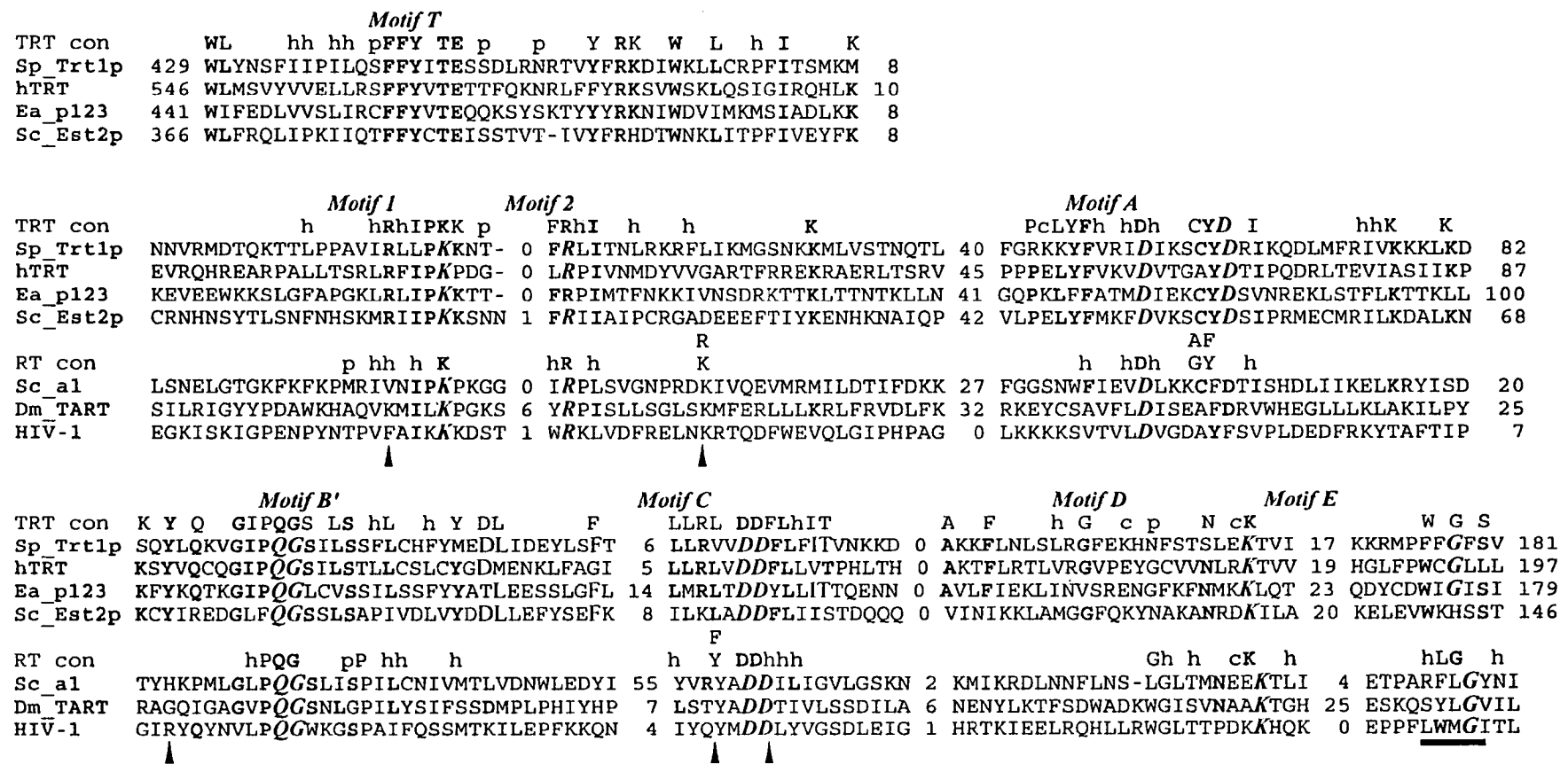

The seven RT motifs found in TRTs, while similar to those found in other reverse transcriptases, have particular hallmarks. For example, as shown in FIG. 4, within the TRT RT motifs there are a number of amino acid substitutions (marked with arrows) in residues highly conserved among the other RTs. For example, in motif C the two aspartic acid residues (DD) that coordinate active site metal ions (see, Kohlstaedt et al., 1992, *Science* 256:1783; Jacobo-Molina et al., 1993, *Proc. Natl. Acad. Sci. U.S.A.* 90:6320; Patel et al., 1995, *Biochemistry* 34:5351) occur in the context hxDD(F/Y) (SEQ ID NO:345) in the telomerase RTs compared to (F/Y)xDDh (SEQ ID NO:346) in the other RTs (where "h" is a hydrophobic amino acid, and "x" is any amino acid; see Xiong et al., 1990, *EMBO J.* 9:3353; Eickbush, in *The Evolutionary Biology of Viruses*, (S. Morse, Ed., Raven Press, NY, p. 121, 1994)). Another systematic change characteristic of the telomerase subgroup occurs in motif E, where WxGxSx (SEQ ID NO:347) is a consensus sequence or is conserved among the telomerase proteins, whereas hLGxxh (SEQ ID NO:348) is characteristic of other RTs (Xiong et al., supra; Eickbush supra). This motif E is called the "primer grip", and mutations in this region have been reported to affect RNA priming but not DNA priming (Powell et al., 1997, *J. Biol. Chem.* 272:13262). Because telomerase requires a DNA primer (e.g., the chromosome 3' end), it is not unexpected that telomerase should differ from other RTs in the primer grip region. In addition, the distance between motifs A and B' is longer in the TRTs than is typical for other RTs, which may represent an insertion within the "fingers" region of the structure which resembles a right hand (FIG. 3; see Kohlstaedt et al., supra; Jacobo-Molina et al., supra; and Patel et al., supra).

Moreover, as noted supra, Motif T is an additional hallmark of TRT proteins. This Motif T, as shown, for example in FIG. 4 (W-L-X-Y-X-X-h-h-X-h-h-X-p-F-F-Y-X-T-E-X-p-X-X-X-p-X-X-X-Y-X-R-K-X-X-W (SEQ ID NO:349) [X is any amino acid, h is hydrophobic, p is polar]), comprises a sequence that can be described using the formula:

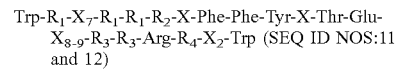

Trp-$R_1$-$X_7$-$R_1$-$R_1$-$R_2$-X-Phe-Phe-Tyr-X-Thr-Glu-$X_{8-9}$-$R_3$-$R_3$-Arg-$R_4$-$X_2$-Trp (SEQ ID NOS:11 and 12)

where X is any amino acid and the subscript refers to the number of consecutive residues, $R_1$ is leucine or isoleucine, $R_2$ is glutamine or arginine, $R_3$ is phenylalanine or tyrosine, and $R_4$ is lysine or histidine.

The T motif can also be described using the formula:

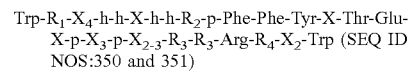

Trp-$R_1$-$X_4$-h-h-X-h-h-$R_2$-p-Phe-Phe-Tyr-X-Thr-Glu-X-p-$X_3$-p-$X_{2-3}$-$R_3$-$R_3$-Arg-$R_4$-$X_2$-Trp (SEQ ID NOS:350 and 351)

where X is any amino acid and a subscript refers to the number of consecutive residues, $R_1$ is leucine or isoleucine, $R_2$ is glutamine or arginine, $R_3$ is phenylalanine or tyrosine, $R_4$ is lysine or histidine, h is a hydrophobic amino acid selected from Ala, Leu, Ile, Val, Pro, Phe, Trp, and Met, and p is a polar amino acid selected from Gly, Ser, Thr, Tyr, Cys, Asn and Gln.

In one embodiment, the present invention provides isolated naturally occurring and recombinant TRT proteins comprising one or more of the motifs illustrated in FIG. 11, e.g., Motif T  W-$X_{12}$-FFY-X-TE-$X_{10-11}$-R-$X_3$-W-$X_7$-I (SEQ ID NOS:352 and 353)
Motif T' E-$X_2$-V-X (SEQ ID NO:354)
Motif 1  $X_3$-R-$X_2$-P-K-$X_3$, (SEQ ID NO:355) or, alternatively, h-R-h-X-P-K (SEQ ID NO:633)
Motif 2  X-R-X-I-X (SEQ ID NO:356) or, alternatively, (F/L)-R-h-I-$X_2$-h (SEQ ID NO:634)
Motif A  $X_4$-F-$X_3$-D-$X_4$-YD-$X_2$, (SEQ ID NO:357) or, alternatively, P-X-L-Y-F-h-X-h-D-h-$X_2$-C-Y-D-X-I (SEQ ID NO:635)
Motif B' Y-$X_4$-G-$X_2$-QG-$X_3$-S-$X_8$ (SEQ ID NO:358) or, alternatively, K-X-Y-X-Q-$X_2$-G-I-P-Q-G-S-X-L-S-X-h-L (SEQ ID NO:636)
Motif C  $X_6$-DD-X-L-$X_3$, (SEQ ID NO:359) or, alternatively, L-L-R-L-X-D-D-X-L-h-I-T (SEQ ID NO:637)

When the TRT protein shown contains more than one TRT motif, the order (NH2→COOH) is as shown in FIG. 11.

In one embodiment, the present invention provides isolated naturally occurring TRT proteins comprising the following supermotif:

(NH$_2$)-X$_{300-600}$-W-X$_{12}$-FFY-X-TE-X$_{10-11}$-R-X$_3$-W-X$_7$-I-X$_{5-20}$-E-X$_2$-V-X-X$_{5-20}$-X$_3$-R-X$_2$-PK-X$_{4-10}$-R-X-I-X-X$_{60-80}$-X$_4$-F-X$_3$-D-X$_4$-YD-X$_2$-X$_{80-130}$-Y-X$_4$-G-X$_2$-QG-X$_3$-S-X$_8$-X$_{5-35}$-X$_6$-DD-X-L-X$_3$-X$_{10-20}$-X$_{12}$-K (SEQ ID NO:727)

It will be apparent to one of skill that, provided with the reagents, including the TRT sequences disclosed herein for those reagents and the methods and guidance provided herein (including specific methodologies described infra), TRT genes and proteins can be obtained, isolated and produced in recombinant form by one of ordinary skill. For example, primers (e.g., degenerate amplification primers) are provided that hybridize to gene sequences encoding RT and T motifs characteristic of TRT. For example, one or more primers or degenerate primers that hybridize to sequences encoding the FFYXTE (SEQ ID NO:360) region of the T motif, other TRT motifs (as discussed infra), or combinations of motifs or consensus sequences, can be prepared based on the codon usage of the target organism, and used to amplify the TRT gene sequence from genomic DNA or cDNA prepared from the target organism. Use of degenerate primers is well known in the art and entails use of sets of primers that hybridize to the set of nucleic acid sequences that can potentially encode the amino acids of the target motif, taking into account codon preferences and usage of the target organism, and by using amplification (e.g., PCR) conditions appropriate for allowing base mismatches in the annealing steps of PCR. Typically two primer sets are used; however, single primer (or, in this case, a single degenerate primer set) amplification systems are well known and may be used to obtain TRT genes.

Table 1 provides illustrative primers of the invention that may be used to amplify novel TRT nucleic acids, particularly those from vertebrates (e.g., humans and other mammals). "N" is an equimolar mixture of all four nucleotides, and nucleotides within parentheses are equimolar mixtures of the specified nucleotides.

that a nucleic acid having the entire TRT protein coding sequence, or a substantial portion thereof, is identified and isolated or cloned. Reagents and methods such as those just described were used in accordance with the methods described herein to obtain TRT gene sequences of *Oxytricha trifallax* and *Tetrahymena thermophila*, as described in detail infra. It will be recognized that following cloning of a previously uncharacterized TRT gene, the sequence can be determined by routine methods and the encoded polypeptide synthesized and assayed for a TRT activity, such as telomerase catalytic activity (as described herein and/or by telomerase assays known in the art).

It will also be apparent to those of skill that TRT genes may be cloned using any of a variety of cloning methods of the invention because the TRT motif sequences and the nucleic acids of the invention comprising such sequences can be used in a wide variety of such methods. For example, hybridization using a probe based on the sequence of a known TRT to DNA or other nucleic acid libraries from the target organism, as described in Example 1 can be used. It will be appreciated that degenerate PCR primers or their amplification products such as those described supra, may themselves be labeled and used as hybridization probes. In another embodiment, expression cloning methods are used. For example, one or more antibodies that specifically bind peptides that span a TRT motif or other TRT epitope, such as the FFYXTE (SEQ ID NO:360) motif can be employed to isolate a ribosomal complex comprising a TRT protein and the mRNA that encodes it. For generating such antibodies of the invention, the peptide immunogens are typically between 6 and 30 amino acids in length, more often about 10 to 20 amino acids in length. The antibodies may also be used to probe a cDNA expression library derived from the organism of interest to identify a clone encoding a TRT sequence. In another embodiment, computer searches

TABLE 1

ILLUSTRATIVE DEGENERATE PRIMERS FOR AMPLIFICATION OF TRT NUCLEIC ACIDS

| motif | motif SEQ ID NO: | direction | 5' sequence-3' | primer SEQ ID NO; |
|---|---|---|---|---|
| a FFYVTE | 361 | Forward | TT(CT)TT(CT)TA(CT)GTNACNGA | 362 |
| b FFYVTE | 361 | Reverse | TCNGTNAC(GA)TA(GA)AA(GA)AA | 363 |
| c RFIPKP | 364 | Forward | (CA)GNTT(CT)AT(ACT)CCNAA(AG)CC | 365 |
| d RFIPKP | 364 | Reverse | GG(TC)TTNGG(TGA)AT(GA)AANC | 366 |
| e AYDTI | 367 | Forward | GCNTA(CT)GA(CT)ACNAT | 368 |
| f AYDTI | 367 | Reverse | TANGT(GA)TC(GA)TANGC | 369 |
| g GIPQG | 370 | Forward | GGNAT(ACT)CCNCA(AG)GG | 371 |
| h GIPQGS | 21 | Reverse | (GC)(AT)NCC(TC)TGNGG(TGA)ATNCC | 372 |
| i LVDDFL | 373 | Forward | (CT)TNGTNGA(CT)GA(CT)TT(CT)(CT)T | 374 |
| j DDFLLVT | 375 | Reverse | GTNACNA(GA)NA(GA)(GA)AA(GA)TC(GA)TC | 376 |

Preferred primer combinations (y = yes, n = no)

| Forward | Reverse | | | | |
|---|---|---|---|---|---|
|  | b | d | f | h | j |
| a- | n | y | y | y | y |
| c- | n | n | y | y | y |
| e- | n | n | n | y | y |
| g- | n | n | n | n | y |
| i- | n | n | n | n | n |

In one embodiment, an amplified TRT nucleic acid is used as a hybridization probe for colony hybridization to a library (e.g., cDNA library) made from the target organism, such of DNA databases for DNAs containing sequences conserved with known TRTs can also be used to identify a clone comprising TRT sequence.

In one aspect, the present invention provides compositions comprising an isolated or recombinant polypeptide having the amino acid sequence of a naturally occurring TRT protein. Usually the naturally occurring TRT has a molecular weight of between about 80,000 daltons (D) and about 150,000 D, most often between about 95,000 D and about 130,000 D. Typically, the naturally occurring TRT has a net positive charge at pH 7 (calculated pI typically greater than 9). In one embodiment, the polypeptide exhibits a telomerase activity as defined herein. In a related embodiment, the polypeptide has a TRT-specific region (T motif) sequence and exhibits a telomerase activity. The invention further provides fragments of such polypeptides. The present invention also provides isolated or recombinant polynucleotide having the sequence of a naturally occurring gene encoding a TRT protein. The invention provides regents useful for isolating sequence of a TRT from non-vertebrate (such as a yeast) and vertebrates, such as mammals (e.g., murine or human). The isolated polynucleotide may be associated with other naturally occurring or recombinant or synthetic vector nucleic acid sequences. Typically, the isolated nucleic acid is smaller than about 300 kb, often less than about 50 kb, more often less than about 20 kb, frequently less than about 10 kb and sometimes less than about 5 kb or 2 kb in length. In some embodiments the isolated TRT polynucleotide is even smaller, such as a gene fragment, primer, or probe of less than about 1 kb or less than 0.1 kb.

III. NUCLEIC ACIDS

A) Generally

The present invention provides isolated and recombinant nucleic acids having a sequence of a polynucleotide encoding a telomerase catalytic subunit protein (TRT), such as a recombinant TRT gene from *Euplotes, Tetrahymena, S. pombe* or humans. Exemplary polynucleotides are provided in FIG. 13 (*Euplotes*); FIG. 15 (*S. pombe*) and FIG. 16 (human, GenBank Accession No. AF015950). The present invention provides sense and anti-sense polynucleotides having a TRT gene sequence, including probes, primers, TRT-protein-encoding polynucleotides, and the like.

B) Human TRT

The present invention provides nucleic acids having a sequence of a telomerase catalytic subunit from humans (i.e., hTRT).

In one aspect, the invention provides a polynucleotide having a sequence or subsequence of a human TRT gene or RNA. In one embodiment, the polynucleotide of the invention has a sequence of SEQ ID NO: 1 shown in FIG. 16 or a subsequence thereof. In another embodiment, the polynucleotide has a sequence of SEQ ID NO:3 (FIG. 18), SEQ ID NO:4 (FIG. 20), or subsequences thereof. The invention also provides polynucleotides with substantial sequence identity to the hTRT nucleic acid sequences disclosed herein, e.g., including but not limited to SEQ ID NOS:1 [FIG. 16], 4 [FIG. 20], 6 [FIG. 21], and 7 [FIG. 12]). Thus, the invention provides naturally occurring alleles of human TRT genes and variant polynucleotide sequences having one or more nucleotide deletions, insertions or substitutions relative to an hTRT nucleic acid sequence disclosed herein. As described infra, variant nucleic acids may be produced using the recombinant or synthetic methods described below or by other means.

The invention also provides isolated and recombinant polynucleotides having a sequence from a flanking region of a human TRT gene. Such polynucleotides include those derived from genomic sequences of untranslated regions of the hTRT mRNA. An exemplary genomic sequence is shown in FIG. 21 (SEQ ID NO:6). As described in Example 4, SEQ ID NO:6 was obtained by sequencing a clone, λGΦ5 isolated from a human genomic library. Lambda GΦ5 contains a 15 kilobasepair (kbp) insert including approximately 13,000 bases 5' to the hTRT coding sequences. This clone contains hTRT promoter sequences and other hTRT gene regulatory sequences (e.g., enhancers).

The invention also provides isolated and recombinant polynucleotides having a sequence from an intronic region of a human TRT gene. An exemplary intronic sequence is shown in FIG. 12 (SEQ ID NO: 7; see Example 3). In some embodiments, hTRT introns are included in "minigenes" for improved expression of hTRT proteins in eukaryotic cells.

In a related aspect, the present invention provides polynucleotides that encode hTRT proteins or protein fragments, including modified, altered and variant hTRT polypeptides. In one embodiment, the encoded hTRT protein or fragment has an amino acid sequence as set forth in FIG. 17 (SEQ ID NO:2), or with conservative substitutions of SEQ ID NO:2. In one embodiment, the encoded hTRT protein or fragment has substitutions that change an activity of the protein (e.g., telomerase catalytic activity).

It will be appreciated that, as a result of the degeneracy of the genetic code, the nucleic acid encoding the hTRT protein need not have the sequence of a naturally occurring hTRT gene, but that a multitude of polynucleotides can encode an hTRT polypeptide having an amino acid sequence of SEQ ID NO:2. The present invention provides each and every possible variation of nucleotide sequence that could be made by selecting combinations based on possible codon choices made in accordance with known triplet genetic codes, and all such variations are specifically disclosed hereby. Thus, although in some cases hTRT polypeptide-encoding nucleotide sequences that are capable of hybridizing to the nucleotide sequence of the naturally occurring sequence (under appropriately selected conditions of stringency) are preferred, it may be advantageous in other cases to produce nucleotide sequences encoding hTRT that employ a substantially different codon usage and so perhaps do not hybridize to nucleic acids with the naturally occurring sequence.

In particular embodiments, the invention provides hTRT oligo- and polynucleotides that comprise a subsequence of an hTRT nucleic acid disclosed herein (e.g., SEQ ID NOS:1 and 6), The nucleic acids of the invention typically comprise at least about 10, more often at least about 12 or about 15 consecutive bases of the exemplified hTRT polynucleotide. Often, the nucleic acid of the invention will comprise a longer sequence, such as at least about 25, about 50, about 100, about 200, or at least about 500 to 3000 bases in length, for example when expression of a polypeptide, or full length hTRT protein is intended.

In still other embodiments, the present invention provides "Δ182 Htrt" polynucleotides having a sequence identical or complementary to naturally occurring or non-naturally occurring hTRT polynucleotides such as SEQ ID NO:3 or SEQ ID NO:4, which do not contain the 182 nucleotide sequence (SEQ ID NO:9) found in pGRN121 (and also absent in clone 712562). These polynucleotides are of interest, in part, because they encode polypeptides that contain different combinations or arrangements of TRT motifs than found in the "full-length" hTRT polypeptide (SEQ ID NO:2) such as is encoded by pGRN121. As discussed infra, it is contemplated that these polypeptides may play a biological role in nature (e.g., in regulation of telomerase expression in cells) and/or find use as therapeutics (e.g., as dominant-negative products that inhibit function of wild-type proteins), or have other roles and uses, e.g. as described herein.

For example, in contrast to the polypeptide encoded by pGRN121, clone 712562 encodes a 259 residue protein with a calculated molecular weight of approximately 30 kD (hereinafter, "712562 hTRT"). The 712562 hTRT polypeptide (SEQ ID NO:10 [FIG. 19]) contains motifs T, 1, 2, and A, but not motifs B', C, D and E (See FIG. 4). Similarly, a variant hTRT polypeptide with therapeutic and other activities may be expressed from a nucleic acid similar to the pGRN121 cDNA but lacking the 182 basepairs missing in clone 712562, e.g., having the sequence shown in FIG. 20 (SEQ ID NO:4). This nucleic acid (hereinafter, "pro90 hTRT"), which may be synthesized using routine synthetic or recombinant methods as described herein, encodes a protein of 807 residues (calculated molecular weight of approximately 90 kD) that shares the same amino terminal sequence as the hTRT protein encoded by SEQ ID NO:1, but diverges at the carboxy-terminal region (the first 763 residues are common, the last 44 residues of pro90 hTRT are different than "full-length" hTRT). The pro90 hTRT polypeptide contains motifs T, 1, 2, and A, but not motifs B, C, D, E, and thus may have some, but not likely all telomerase activities.

C) Production of Human TRT Nucleic Acids

The polynucleotides of the invention have numerous uses including, but not limited to, expression of polypeptides encoding hTRT or fragments thereof, use as sense or antisense probes or primers for hybridization and/or amplification of naturally occurring hTRT genes or RNAs (e.g. for diagnostic or prognostic applications), and as therapeutic agents (e.g., in antisense, triplex, or ribozyme compositions). As will be apparent upon review of the disclosure, these uses will have enormous impact on the diagnosis and treatment of human diseases relating to aging, cancer, and fertility as well as the growth, reproduction, and manufacture of cell-based products. As described in the following sections, the hTRT nucleic acids of the invention may be made (e.g., cloned, synthesized, or amplified) using techniques well known in the art.

1) Cloning, Amplification, and Recombinant Production

In one embodiment, hTRT genes or cDNAs are cloned using a nucleic acid probe that specifically hybridizes to an hTRT mRNA, cDNA, or genomic DNA. One suitable probe for this purpose is a polynucleotide having all or part of the sequence provided in FIG. 16 (SEQ ID NO:1), such as a probe comprising a subsequence thereof. Typically, the target hTRT genomic DNA or cDNA is ligated into a vector (e.g., a plasmid, phage, virus, yeast artificial chromosome, or the like) and may be isolated from a genomic or cDNA library (e.g., a human placental cDNA library). Once an hTRT nucleic acid is identified, it can be isolated according to standard methods known to those of skill in the art. An illustrative example of screening a human cDNA library for the hTRT gene is provided in Example 1; similarly, an example of screening a human genomic library is found in Examples 3 and 4. Cloning methods are well known and are described, for example, in Sambrook et al., (1989) MOLECULAR CLONING: A LABORATORY MANUAL, 2ND ED., VOLS. 1-3, Cold Spring Harbor Laboratory hereinafter, "Sambrook"); Berger and Kimmel, (1987) METHODS IN ENZYMOLOGY, VOL.152: GUIDE TO MOLECULAR CLONING TECHNIQUES, San Diego: Academic Press, Inc.; Ausubel et al., CURRENT PROTOCOLS IN MOLECULAR BIOLOGY, Greene Publishing and Wiley-Interscience, New York (1997); Cashion et al., U.S. Pat. No. 5,017,478; and Carr, European Patent No. 0,246,864.

The invention also provides hTRT genomic or cDNA nucleic acids isolated by amplification methods such as the polymerase chain reaction (PCR). In one embodiment, hTRT protein coding sequence is amplified from an RNA or cDNA sample (e.g., double stranded placental cDNA (Clontech, Palo Alto Calif.)) using the primers 5'-GTGAAG-GCACTGTTCAGCG-3' ("TCP1.1") (SEQ ID NO:377) and 5'-CGCGTGGGTGAGGTGAGGTG-3 ("TCP 1.15") (SEQ ID NO:378). In some embodiments a third primer or second pair of primers may be used, e.g., for "nested PCR", to increase specificity. One example of a second pair of primers is 5'-CTGTGCTGGGCCTGGACGATA-3' ("TCP1.14") (SEQ ID NO:379) and 5'-AGCTTGTTCTCCATGTCGC-CGTAG-3' ("billTCP6") (SEQ ID NO:380). It will be apparent to those of skill that numerous other primers and primer combinations, useful for amplification of hTRT nucleic acids are provided by the present invention.

Moreover, the invention provides primers that amplify any specific region (e.g., coding regions, promoter regions, and/or introns) or subsequence of hTRT genomic DNA, cDNA or RNA. For example, the hTRT intron at position 274/275 of SEQ ID NO:1 (see Example 3) may be amplified (e.g., for detection of genomic clones) using primers TCP1.57 and TCP1.52 (primer pair 1) or primers TCP1.49 and TCP1.50 (primer pair 2). (Primer names refer to primers listed in Table 2, infra.) The primer pairs can be used individually or in a nested PCR where primer set 1 is used first. Another illustrative example relates to primers that specifically amplify and so detect the 5' end of the hTRT mRNA or the exon encoding the 5' end of hTRT gene (e.g., to assess the size or completeness of a cDNA clone). The following primer pairs are useful for amplifying the 5' end of hTRT: primers K320 and K321 (primer pair 3); primers K320 and TCP1.61 (primer pair 4); primers K320 and K322 (primer pair 5). The primer sets can be used in a nested PCR in the order set 5, then set 4 or set 3, or set 4 or set 5, then set 3. Yet another illustrative example involves primers chosen to amplify or detect specifically the conserved hTRT TRT motif region comprising approximately the middle third of the mRNA (e.g., for use as a hybridization probe to identify TRT clones from, for example, nonhuman organisms). The following primer pairs are useful for amplifying the TRT motif region of hTRT nucleic acids: primers K304 and TCP 1.8 (primer pair 6), or primers Lt1 and TCP 1.15 (primer pair 7). The primer sets can be used in a nested PCR experiment in the order set 6 then set 7.

Suitable PCR amplification conditions are known to those of skill and include (but are not limited to) 1 unit Taq polymerase (Perkin Elmer, Norwalk Conn.), 100 µM each dNTP (dATP, dCTP, dGTP, dTTP), 1×PCR buffer (50 mM KCl, 10 mM Tris, pH 8.3 at room temperature, 1.5 mM MgCl$_2$, 0.01% gelatin) and 0.5 µM primers, with the amplification run for about 30 cycles at 94° for 45 sec, 55° for 45 sec and 72° for 90 sec. It will be recognized by those of skill in the art that other thermostable DNA polymerases, reaction conditions, and cycling parameters will also provide suitable amplification. Other suitable in vitro amplification methods that can be used to obtain hTRT nucleic acids include; but are not limited to, those herein, infra. Once amplified, the hTRT nucleic acids can be cloned, if desired, into any of a variety of vectors using routine molecular biological methods or detected or otherwise utilized in accordance with the methods of the invention.

One of skill will appreciate that the cloned or amplified hTRT nucleic acids obtained as described above can be prepared or propagated using other methods, such as chemical synthesis or replication by transformation into bacterial systems, such as *E. coli* (see, e.g., Ausubel et al., supra), or eukaryotic, such as mammalian, expression systems. Similarly, hTRT RNA can be expressed in accordance with the present in vitro methods, or in bacterial systems such as *E. coli* using, for example, commercially available vectors containing promoters recognized by an RNA polymerase such as T7, T3 or SP6, or transcription of DNA generated by PCR amplification using primers containing an RNA polymerase promoter.

The present invention further provides altered or modified hTRT nucleic acids. It will be recognized by one of skill that the cloned or amplified hTRT nucleic acids obtained can be modified (e.g., truncated, derivatized, altered) by methods well known in the art (e.g., site-directed mutagenesis, linker scanning mutagenesis) or simply synthesized de novo as described below. The altered or modified hTRT nucleic acids are useful for a variety of applications, including, but not limited to, facilitating cloning or manipulation of an hTRT gene or gene product, or expressing a variant hTRT gene product. For example, in one embodiment, the hTRT gene sequence is altered such that it encodes an hTRT polypeptide with altered properties or activities, as discussed in detail in infra, for example, by mutation in a conserved motif of hTRT. In another illustrative example, the mutations in the protein coding region of an hTRT nucleic acid may be introduced to alter glycosylation patterns, to change codon preference, to produce splice variants, remove protease-sensitive sites, create antigenic domains, modify specific activity, and the like. In other embodiments, the nucleotide sequence encoding hTRT and its derivatives is changed without altering the encoded amino acid sequences, for example, the production of RNA transcripts having more desirable properties, such as increased translation efficiency or a greater or a shorter half-life, compared to transcripts produced from the naturally occurring sequence. In yet another embodiment, altered codons are selected to increase the rate at which expression of the peptide occurs in a particular prokaryotic or eukaryotic expression host in accordance with the frequency with which particular codons are utilized by the host. Useful in vitro and in vivo recombinant techniques that can be used to prepare variant hTRT polynucleotides of the invention are found in Sambrook et al. and Ausubel et al., both supra.

As noted supra, the present invention provides nucleic acids having flanking (5' of 3') and intronic sequences of the hTRT gene. The nucleic acids are of interest, inter alia, because they contain promoter and other regulatory elements involved in hTRT regulation and useful for expression of hTRT and other recombinant proteins or RNA gene products. It will be apparent that, in addition to the nucleic acid sequences provided in SEQ ID NOS:6 and 7, additional hTRT intron and flanking sequences may be readily obtained using routine molecular biological techniques. For example, additional hTRT genomic sequence may be obtained from Lambda clone GΦ5 (ATCC Accession No. 209024), described supra and in Example 4. Still other hTRT genomic clones and sequences may be obtained by screening a human genomic library using an hTRT nucleic acid probe having a sequence or subsequence from SEQ ID NO:1. Additional clones and sequences (e.g., still further upstream) may be obtained by using labeled sequences or subclones derived from λGΦ5 to probe appropriate libraries. Other useful methods for further characterization of hTRT flanking sequences include those general methods described by Gobinda et al., 1993, *PCR Meth. Applic.* 2:318; Triglia et al., 1988, *Nucleic Acids Res.* 16:8186; Lagerstrom et al., 1991, *PCR Methods Applic.* 1:111; and Parker et al., 1991, *Nucleic Acids Res.* 19:3055.

Intronic sequences can be identified by routine means such as by comparing the hTRT genomic sequence with hTRT cDNA sequences (see, e.g., Example 3), by S1 analysis (see Ausubel et al., supra, at Chapter 4), or various other means known in the art. Intronic sequences can also be found in pre-mRNA (i.e., unspliced or incompletely spliced mRNA precursors), which may be amplified or cloned following reverse transcription of cellular RNA.

When desired, the sequence of the cloned, amplified, or otherwise synthesized hTRT or other TRT nucleic acid can be determined or verified using DNA sequencing methods well known in the art (see, e.g., Ausubel et al., supra). Useful methods of sequencing employ such enzymes as the Klenow fragment of DNA polymerase I, Sequenase (US Biochemical Corp, Cleveland Ohio), Taq DNA polymerase (Perkin Elmer, Norwalk Conn.), thermostable T7 polymerase (Amersham, Chicago Ill.), or combinations of recombinant polymerases and proofreading exonucleases such as the ELONGASE Amplification System marketed by Gibco BRL (Gaithersburg Md.). When sequencing or verifying the sequence of oligonucleotides (such as oligonucleotide made de novo by chemical synthesis), the method of Maxam and Gilbert may be preferred (Maxam and Gilbert, 1980, *Meth. Enz.* 65:499; Ausubel et al., supra, Ch. 7).

The 5' untranslated sequences of hTRT or other TRT mRNAs can be determined directly by cloning a "full-length" hTRT or other cDNA using standard methods such as reverse transcription of mRNA, followed by cloning and sequencing the resulting cDNA. Preferred oligo(dT)-primed libraries for screening or amplifying full length cDNAs that have been size-selected to include larger cDNAs may be preferred. Random primed libraries are also suitable and often include a larger proportion of clones that contain the 5' regions of genes. Other well known methods for obtaining 5' RNA sequences, such as the RACE protocol described by Frohman et al., 1988, *Proc. Nat. Acad. Sci. USA* 85:8998, may also be used. If desired, the transcription start site of an hTRT or other TRT mRNA can be determined by routine methods using the nucleic acids provided herein (e.g., having a sequence of SEQ ID NO:1). One method is S1 nuclease analysis (Ausubel et al., supra) using a labeled DNA having a sequence from the 5' region of SEQ ID NO:1.

2) Chemical Synthesis of Nucleic Acids

The present invention also provides hTRT polynucleotides (RNA, DNA or modified) that are produced by direct chemical synthesis. Chemical synthesis is generally preferred for the production of oligonucleotides or for oligonucleotides and polynucleotides containing nonstandard nucleotides (e.g., probes, primers and antisense oligonucleotides). Direct chemical synthesis of nucleic acids can be accomplished by methods known in the art, such as the phosphotriester method of Narang et al., 1979, *Meth. Enzymol.* 68:90; the phosphodiester method of Brown et al., *Meth. Enzymol.* 68:109 (1979); the diethylphosphoramidite method of Beaucage et al., *Tetra. Lett.*, 22:1859 (1981); and the solid support method of U.S. Pat. No. 4,458,066. Chemical synthesis typically produces a single stranded oligonucleotide, which may be converted into double stranded DNA by hybridization with a complementary sequence, or by polymerization with a DNA polymerase and an oligonucleotide primer using the single strand as a template. One of skill will recognize that while chemical synthesis of DNA is often limited to sequences of about 100 or 150 bases, longer sequences may be obtained by the ligation of shorter sequences or by more elaborate synthetic methods.

It will be appreciated that the hTRT (or hTR or other) polynucleotides and oligonucleotides of the invention can be made using nonstandard bases (e.g., other than adenine, cytidine, guanine, thymine, and uridine) or nonstandard backbone structures to provides desirable properties (e.g., increased nuclease-resistance, tighter-binding, stability or a desired $T_M$). Techniques for rendering oligonucleotides nuclease-resistant include those described in PCT publication WO 94/12633. A wide variety of useful modified oligonucleotides may be produced, including oligonucleotides having a peptide-nucleic acid (PNA) backbone (Nielsen et al., 1991, *Science* 254:1497) or incorporating 2'-O-methyl ribonucleotides, phosphorothioate nucleotides, methyl phosphonate nucleotides, phosphotriester nucleotides, phosphorothioate nucleotides, phosphoramidates. Still other useful oligonucleotides may contain alkyl and halogen-substituted sugar moieties comprising one of the following at the 2' position: OH, SH, $SCH_3$, F, OCN, $OCH_3OCH_3$, $OCH_3O(CH_2)_nCH_3$, $O(CH_2)_nNH_2$ or $O(CH_2)_nCH_3$ where n is from 1 to about 10; $C_1$ to $C_{10}$ lower alkyl, substituted lower alkyl, alkaryl or aralkyl; Cl; Br; CN; $CF_3$; $OCF_3$; O-, S-, or N-alkyl; O-, S-, or N-alkenyl; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a cholesteryl group; a folate group; a reporter group; an intercalator; a group for improving the pharmacokinetic properties of an oligonucleotide; or a group for improving the pharmacodynamic properties of an oligonucleotide and other substituents having similar properties. Folate, cholesterol or other groups which facilitate oligonucleotide uptake, such as lipid analogs, may be conjugated directly or via a linker at the 2' position of any nucleoside or at the 3' or 5' position of the 3'-terminal or 5'-terminal nucleoside, respectively. One or more such conjugates may be used. Oligonucleotides may also have sugar mimetics such as cyclobutyls in place of the pentofuranosyl group. Other embodiments may include at least one modified base form or "universal base" such as inosine, or inclusion of other nonstandard bases such as queosine and wybutosine as well as acetyl-, methyl-, thio- and similarly modified forms of adenine, cytidine, guanine, thymine, and uridine which are not as easily recognized by endogenous endonucleases. The invention further provides oligonucleotides having backbone analogues such as phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, chiral-methyl phosphonates, nucleotides with short chain alkyl or cycloalkyl intersugar linkages, short chain heteroatomic or heterocyclic intersugar ("backbone") linkages, or $CH_2$—NH—O—$CH_2$, $CH_2$—N($CH_3$)—$OCH_2$, $CH_2$—O—N($CH_3$)—$CH_2$, $CH_2$—N($CH_3$)—N($CH_3$)—$CH_2$ and O—N($CH_3$)—$CH_2$—$CH_2$ backbones (where phosphodiester is O—P—O—$CH_2$), or mixtures of the same. Also useful are oligonucleotides having morpholino backbone structures (U.S. Pat. No. 5,034,506).

Useful references include Oligonucleotides and Analogues, A Practical Approach, edited by F. Eckstein, IRL Press at Oxford University Press (1991); Antisense Strategies, Annals of the New York Academy of Sciences, Volume 600, Eds. Baserga and Denhardt (NYAS 1992); Milligan et al., 9 Jul. 1993, J. Med. Chem. 36(14):1923-1937; Antisense Research and Applications (1993, CRC Press), in its entirety and specifically Chapter 15, by Sanghvi, entitled "Heterocyclic base modifications in nucleic acids and their applications in antisense oligonucleotides." Antisense Therapeutics, ed. Sudhir Agrawal (Humana Press, Totowa, N.J., 1996).

D) Labeling Nucleic Acids

It is often useful to label the nucleic acids of the invention, for example, when the hTRT or other oligonucleotides or polynucleotides are to be used as nucleic acid probes. The labels (see infra) may be incorporated by any of a number of means well known to those of skill in the art. In one embodiment, an unamplified nucleic acid (e.g., mRNA, polyA mRNA, cDNA) is labeled. Means of producing labeled nucleic acids are well known to those of skill in the art and include, for example, nick-translation, random primer labeling, end-labeling (e.g. using a kinase), and chemical conjugation (e.g., photobiotinylation) or synthesis. In another embodiment, the label is simultaneously incorporated during an amplification step in the preparation of the sample nucleic acids. Thus, for example, polymerase chain reaction (PCR) or other nucleic acid amplification method with labeled primers or labeled nucleotides will provide a labeled amplification product. In another embodiment, transcription amplification using a labeled nucleotide (e.g. fluorescein-labeled UTP and/or CTP) incorporates a label into the transcribed nucleic acids. An amplification product may also, or alternatively, be labeled after the amplification is completed.

E) Illustrative Oligonucleotides

As noted supra and discussed in detail infra, oligonucleotides are used for a variety of uses including as primers, probes, therapeutic or other antisense oligonucleotides, triplex oligonucleotides, and numerous other uses as apparent from this disclosure. Table 2 provides certain illustrative specific oligonucleotides that may be used in the practice of the invention. It will be appreciated that numerous other useful oligonucleotides of the invention may be synthesized by one of skill, following the guidance provided herein.

In Table 2, "seq" means that the primer has been used, or is useful, for sequencing; "PCR" means that the primer has been used, or is useful, for PCR; "AS" means that means that the primer has been used, or is useful for antisense inhibition of telomerase activity; "CL" means that the primer has been used, or is useful in cloning regions of hTRT genes or RNA, "mut" means that the primer has been used, or is useful for constructing mutants of hTRT genes or gene products. "UC," means "upper case," and "lc" means "lower case." Mismatches and insertions (relative to SEQ ID NO:1) are indicated by underlining; deletions are indicated by a "–". It will be appreciated that nothing in Table 2 is intended to limit the use of any particular oligonucleotide to any single use or set of uses.

TABLE 2

USEFUL OLIGONUCLEOTIDES

| primer | 5'-sequence-3'* | Notes | mismatch?* | seq | USE PCR | AS | CL | MUT | SEQ ID |
|---|---|---|---|---|---|---|---|---|---|
| TCP1.1 | GTGAAGGCACTGTTCAGCG | | | x | x | | | | 377 |
| TCP1.2 | GTGGATGATTTCTTGTTGG | | | x | x | | | | 381 |
| TCP1.4 | CTGGACACTTCAGCCCTTGG | | | x | x | | | | 382 |
| TCP1.5 | GGCAGGTGTGCTGGACACT | | | x | x | | | | 383 |
| TCP1.6 | TTTGATGATGCTGGCGATG | | | x | x | | | | 384 |
| TCP1.7 | GGGGCTCGTCTTCTACAGG | | Y | x | x | | | | 385 |
| TCP1.8 | CAGCAGGAGGATCTTGTAG | | | x | x | | | | 386 |
| TCP1.9 | TGACCCCAGGAGTGGCACG | | | x | x | | | | 387 |
| TCP1.10 | TCAAGCTGACTCGACACCG | | | x | x | | | | 388 |
| TCP1.11 | CGGCGTGACAGGGCTGC | | | x | x | | | | 389 |
| TCP1.12 | GCTGAAGGCTGAGTGTCC | | | x | x | | | | 390 |
| TCP1.13 | TAGTCCATGTTCACAATCG | | | x | x | | | | 391 |
| TCP1.14 | CTGTGCTGGGCCTGGACGATA | | | x | x | | | | 379 |
| TCP1.15 | CGCGTGGGTGAGGTGAGGTG | | | x | x | | | | 378 |
| TCP1.16 | TTTCCGTGTTGAGTGTTTC | | | x | x | | | | 392 |
| TCP1.17 | GTCACCGTGTTGGGCAGG | | | x | x | | | | 393 |
| TCP1.19 | GCTACCTGCCCAACACGG | | | x | x | | | | 394 |
| TCP1.20 | GCGCGAAGAACGTGCTGG | | | x | x | | | | 395 |
| TCP1.21 | CA-CTGCTCCTTGTCGCCTG | | Y | x | x | | | | 396 |
| TCP1.22 | TTCCCAAGGACTTTGTTGC | | | x | x | | | | 397 |
| TCP1.24 | TGTTCCTCAAGACGCACTG | | Y | x | x | | | | 398 |
| TCP1.25 | TACTGCGTGCGTCGGTATG | | | x | x | | | | 399 |
| TCP1.26 | GGTCTTGCGGCTGAAGTGT | | | x | x | | | | 400 |
| TCP1.27 | TGGTTCACCTGCTGGCACG | | | x | x | | | | 401 |
| TCP1.28 | GTGGTTTCTGTGTGGTGTC | | | x | x | | | | 402 |
| TCP1.29 | GACACCACAGAGAAACCAC | | | x | x | | | | 403 |
| TCP1.30 | GTGCCAGCAGGTGAACCAG | | | x | x | | | | 404 |
| TCP1.32B | GCAGTGCGTCTTGAGGAGC | | | x | x | | | | 405 |
| TCP1.33 | TGGAACCATAGCGTCAGGGAG | | | x | x | | | | 406 |
| TCP1.34 | GGCCTCCCTGACGCTATGGTT | | | x | x | | | | 407 |
| TCP1.35 | GC(GT)CGGGCGCTGCCACTCAGG | | | x | x | | | | 408 |
| TCP1.35t | GCTCGGGCGCTGCCACTCAGG | | | | x | | | | 409 |
| TCP1.36 | ACGCCGAGACCAAGCACTTC | | | x | x | | | | 410 |
| TCP1.38 | CCAAAGAGGTGGCTTCTTCG | | | x | x | | | | 411 |
| TCP1.39 | AAGGCCAGCACGTTCTTCGC | | | x | x | | | | 412 |
| TCP1.40 | CACGTTCGTGCGGCGCCTG | | | x | x | | | | 413 |
| TCP1.41 | CCTTCACCACCAGCGTGCG | | | x | x | | | | 414 |
| TCP1.42 | GGCGACGACGTGCTGGTTC | | | x | x | | | | 415 |
| TCP1.43 | GGCTCAGGGGCAGCGCCAC | | | x | x | | | | 416 |
| TCP1.44 | CTGGCAGGTGTACGGCTTC | | | x | x | | | | 417 |
| TCP1.45 | GCGTGGACCGAGTGACCGTGGTTTC | | | x | x | | | | 418 |
| TCP1.46 | GACGTGGTGGCCGGCGATGTGG | | | x | x | | | | 419 |
| TCP1.47 | GAAGTCTGCCGTTGCCCAAGAG | | | x | x | | | | 420 |
| TCP1.48 | GACACCACAGAGAAACCACGGTCAC | | | x | x | | | | 421 |

TABLE 2-continued

USEFUL OLIGONUCLEOTIDES

| primer | 5'-sequence-3'* | Notes | mismatch?* | seq | USE PCR | AS | CL | MUT | SEQ ID |
|---|---|---|---|---|---|---|---|---|---|
| TCP1.49 | CGCCCCTCCTTCCGCCAGGT | | | x | x | | | | 422 |
| TCP1.50 | CGAAGCCGAAGGCCAGCACGTTCTT | | | x | x | | | | 423 |
| TCP1.51 | GGTGGCCGAGTGCTGCAGAGG | | | x | x | | | | 424 |
| TCP1.52 | GTAGCTGGCCACGCTGGTGGTGAAG | | | x | x | | | | 425 |
| TCP1.53 | TGGGGGACGACGTGCTGGTTCA | | | x | x | | | | 426 |
| TCP1.54 | TATGGTTTCCAGGCCCGTTCGCATCC | | | x | x | | | | 427 |
| TCP1.55 | CCAGCTGCGCTACCAGGTGTGC | | | x | x | | | | 428 |
| TCP1.56 | GGCCTCCCTGACGCTATGGTTCCAG | | | x | x | | | | 429 |
| TCP1.57 | GGTGCTGCGCTGGCCACGTTCG | | | x | x | | | | 430 |
| TCP1.58 | TCCCAGGGCACGCACACCAGGCACT | | | x | x | | | | 431 |
| TCP1.59 | GTACAGGGCACACCTTTGGTCACTC | | | x | x | | | | 432 |
| TCP1.60 | TCGACGACGTACACACTCATCAGCC | | | x | x | | | | 433 |
| TCP1.61 | AGCGGCAGCACCTCGCGTAGTGGC | | | x | x | | | | 434 |
| TCP1.62 | CCACCAGCTCCTTCAGGCAGGACAC | | | x | x | | | | 435 |
| TCP1.63 | CCAGGGCTTCCCACGTGCGCCAGCAG | | | x | x | | | | 436 |
| TCP1.64 | CGCACGAACGTTGGCCAGCGCAGCA | | | x | x | | | | 437 |
| TCP1.65 | TGACCGTGGTTTCTGGTGGTGT | | | x | x | | | | 438 |
| TCP1.66 | CCCTCTTCAAGTGCTGTCTGATTCC | | | x | x | | | | 439 |
| TCP1.67 | ATCGCGGCCACCACGTCCCT | | | x | x | | | | 440 |
| TCP1.68 | TGCTCCAGACACTCGGCCGGTAGAA | | | x | x | | | | 441 |
| TCP1.69 | ACGAAGCGTACACCTGCC | | | x | x | | | | 442 |
| TCP1.72 | CGACATCCCTGCGTTCTTGGCTTC | | | x | x | | | | 443 |
| TCP1.73 | CACTGCTGGCCTCATTCAGGG | | | x | x | | | | 444 |
| TCP1.74 | GCGACATGGAGAACAAGC | | | x | x | | | | 445 |
| TCP1.75 | GCAGCCATACTCAGGGACAC | | | x | x | | | | 446 |
| TCP1.76 | CCATCCTCTCCACGCTGTCTC | | | x | x | | | | 447 |
| TCP1.77 | GCGATGACCTCCGTGAGCCTG | | | x | x | | | | 448 |
| TCP1.78 | CCCAGGACAGGCTCACGGA | | | x | x | | | | 449 |
| billTCP1 | CCTCTTCAAGTGCTGTCTGATTCC | | | x | x | | | | 450 |
| billTCP2 | CAGCTGCGACGACGTACACACTCATC | | | x | x | | | | 451 |
| billTCP4 | CTGACGTCCAGACTCCGCTTCAT | | | x | x | | | | 452 |
| billTCP6 | AGCTTGTTCTCCATGTCGCCGTAG | | | x | x | | | | 380 |
| nprim01 | GACCTGAGCAGCTCGACGACGTACACAC TCATC | | | x | x | | | | 453 |
| Lt1 | GTCGTGAGCTGCTCAGGTC | | | x | x | | | | 454 |
| Lt2 | AGCACGCTGAACAGTGCCTT | | | x | x | | | | 455 |
| Lt3 | GACCTGAGCAGCTGCGACGAC | | | x | x | | | | 456 |
| Lt4 | AAGGCACTGTTCAGGTGCT | | | x | x | | | | 457 |
| Lt5 | CGGCCGAGTGTCTGGAGCAA | | Y | x | x | | | | 458 |
| Lt6 | GGATGAAGCGGAGTCTGGA | | | x | x | | | | 459 |
| BamHILt7 | ATGGATCCGTCGTCGAGCTGCTCAGGTCT | BamHI site | Y | | x | | x | | 460 |
| SalILt8 | ATCAGC | Pvu II site (not Sal I) | Y | | x | | x | | 461 |
| K303 | TGAGCACGCTGAACATAAAAGAAAGAC | | | x | x | | | | 462 |
| K304 | GCCAAGTTCCTGCACTGGCT | | | x | x | | | | 463 |

TABLE 2-continued

USEFUL OLIGONUCLEOTIDES

| primer | 5'-sequence-3'* | Notes | mismatch?* | seq | USE PCR | AS | CL | MUT | SEQ ID |
|---|---|---|---|---|---|---|---|---|---|
| K305 | GCCTGTTCTTTTGAAACGTGGTCT | X = biotin, = K305 | | x | x | | | | 464 |
| K306 | XXGCCTGTTCTTTTGAAACGTGGTCT | | | x | x | | | | 465 |
| K311 | GTCAAGATGCCTGAGATAGAAC | | | x | x | | | | 466 |
| K312 | TGCTTAGCTTGTGGGGGTGTCA | | | x | x | | | | 467 |
| K313 | TGCTTAGCTTGTGGGGGTGTCA | | | x | x | | | | 467 |
| K320 | GCTGCGTCCTGCTGCGCACGT | | | x | x | | | | 468 |
| K321 | CAGCGGGGAGCGCGCGGCATC | | | x | x | | | | 469 |
| K322 | TGGGCCACCAGCGCGCGGAAA | | | x | x | | | | 470 |
| slanti.1 | CGGCGCAGCCCGTCAGGCTTGGGG | | Y | x | x | | | | 471 |
| slanti.2 | CCGACAGCTCCCGCAGCTGCACCC | | Y | x | x | | | | 472 |
| slanti.3 | CGTACACACTCATCAGCCAGTGCAGGAA CTTGGC | | | x | x | | | | 473 |
| slanti.4 | CGCGCCCGCTCGTAGTTGAGCACGCTGA ACAGTGCCTTC ACCCTCG | | | x | x | | | | 474 |
| slanti.5 | GCGGAGTCTGGACGTCAGCAGGGCGGGC CTGGCTTCCCG | | | x | x | | | | 475 |
| UTR2 | ATTTGACCACCAGGGACCCCCATCCAG | | | x | x | | | | 476 |
| FW5 | ATGACCGCCCTCCTCGTGAG | | | x | x | | | | 477 |
| Nam1 | GCCACCCCGCGATGCC | | | x | x | | | | 478 |
| Nam2 | AGCCCTGGCCCCGGCCA | | | x | x | | | | 479 |
| Nam3 | TCCCACGTGCGCAGCAG | | | x | x | | | | 480 |
| Nam4 | AGCAGGACGCAGCGCTG | | | x | x | | | | 481 |
| PE01 | CGCGGTAGTTGGCTGCGCAGCAGGGAGCG CACGGC | | | x | x | | | | 482 |
| PE02 | CCAGGGCTTCCCACGTGCGCAGCAGGAC GCAGCGC | | | x | x | | | | 483 |
| LM101 | CTAGTCTAGATCA/ GCTAGGCGTAATCTGGAACATCGTA TGGGTA/GTCCAGGATGGTCTTGAAGTC | Xba I site/HA tag/hTRT into pGRN121 | | | | | | x | 484 |
| LM103 | TACCATGGGCTACCCATACGACGTTCCAG ATTACGCTCA | inserts HA tag into a Nde I site at 5' end of hTRT | | | | | | x | 485 |
| LM104 | TATGAGCGTAATCTGGAACGTCGTATGGG TAGCCCATGG | anneals to LM103 | | | | | | x | 486 |
| LM105 | GTGTACGTCGTCGAGCTCCTCAGGTCTGC CTTTT ATGTCACGGAG | change = F560A (phe > ala) | | | | | | x | 487 |
| LM106 | GTGTACGTCGTCGAGCTCCTCAGGTCTTT CGCTTATGTC ACGGAGACC | change = F561A (phe > ala) | | | | | | x | 488 |
| LM107 | CCCTCAGGTCTTTCTTTGCTGTCACGGAGA CAACGTTT CAAAAGAACAG | change = Y562A (tyr > ala) | | | | | | x | 489 |
| LM108 | GGTCTTTCTTTTATGTCGCGGAGACAACG TTT CAAAAGAACAG | change = T564A (thr > ala) | | | | | | x | 490 |

TABLE 2-continued

USEFUL OLIGONUCLEOTIDES

| primer | 5'-sequence-3'* | Notes | mismatch?* | USE seq | USE PCR | AS | CL | MUT | SEQ ID |
|---|---|---|---|---|---|---|---|---|---|
| LM109 | CTTTCTTTTATGTCACGGGACAACGTTT CAAAGAACA | change = E565A | | | | | | x | 491 |
| LM_FFYTE | ATGAGTGTGTACGTCGTCGAGCTCCTCAG GTCTACCACG | deletion of FFYVTE (aa560-565) | | | | | | x | 492 |
| TCP061: | TTTCAAAAGAACAGGCTCTTTTC GGCTGATGAGTGTGTACGTCGTGA | complement to TCP1.61 | | x | | | | | 493 |
| HUMO1: | ACGTGGTCTCCGTGACATAAAAGAA | to DD motif, designed to possibly anneal to mTRT | | x | x | | | | 494 |
| HUMO2: | AGGTCTTTCTTTTATGTCACGGA | to DD motif, designed to possibly anneal to mTRT | | x | x | | x | | 495 |
| HUMO3: | CACAGACCCCGTCGCCTGGTC | designed to possibly anneal to mTRT | | x | x | | x | | 496 |
| HUMO4: | CGGAGTCTGGACGTCAGCAGGGC | possibly anneal to mTRT | | x | x | | x | | 497 |
| SLW F1N | cgcggatccgtaactaaaATGCCGCGCGCTCCCCG CTGC | for GST fusion construct (782 to 1636) UC = hTRT seq, 1c = BamHI site + 2 stop codons | | | x | | x | | 498 |
| SLW F1C | ccggaattcgttagttacttaCAAAGAGGTGGCTTCTT CGGC | for GST fusion construct (782 to 1636) UC = hTRT seq, 1c = EcoR I site + 3 stop codons | | | x | | x | | 499 |
| SLW F2N | SLW F1N/SLW F1C amplify a 893 nt piece of pGRN121 (782 to 1636) cgcggatccgtaactaaaGCCACCTCTTTGGAGGTGCG | for GST fusion construct (1625 to 2458) UC = hTRT seq, 1c = BamHI site + 2 stop codons | | | x | | x | | 500 |
| SLW F2C | ccggaattcgttagttactaAGACCTGAGCAGCTCGACGAC | for GST fusion construct (1625 to 2458) UC = hTRT seq, 1c = EcoR I site + 3 stop codons | | | x | | x | | 501 |
| SLW F3N | SLW F2N/SLW F2C amplify a 872 nt piece of pGRN121 (1625 to 2458) cgcggatccgtaactaaaATGAGTGTGTACGTCGTCGAG | for GST fusion construct (2426 to 3274) UC = hTRT seq, 1c = BamHI site + 2 stop codons | | | x | | x | | 502 |
| SLW F3C | ccggaattcgttagttactaGATCCCCTGGCACTGGACG | for GST fusion construct (2426 to 3274) UC = hTRT seq, 1c = EcoR I site + 3 stop codons | | | x | | x | | 503 |
| SLW F4N | SLW F3N/SLW F3C amplify a 887 nt piece of pGRN121 (2426 to 3274) cgcggatccgtaactaaaATCCCGCAGGGCTCCATCCTC | for GST fusion construct (3272 to 4177) UC = hTRT seq, 1c BamHI site + 2 stop codons | | | x | | x | | 504 |
| SLW F4C | ccggaattcgttagttactaGTCCAGGATGGTCTTGAAGTC | for GST fusion construct (3272 to 4177) UC = hTRT seq, 1c EcoR I site + 3 stop codons | | | x | | x | | 505 |
| 40-60 | SLW F4N/SLW F4C amplify a 944 nt piece of pGRN121 (3272 to 4177) GGCATCGCGGGGGTGGCCGGG | phosphorothioate | | | | x | | | 506 |
| 260-280 | GGACACCTGGCGGAAGGAGGG | phosphorothioate | | | | x | | | 507 |
| 500-520 | GCGTGCCAGCAGGTGAACCAG | phosphorothioate | | | | x | | | 508 |
| 770-790 | CTCAGGGGCAGCGCACCGCCT | phosphorothioate | | | | x | | | 509 |
| 885-905 | AGGTGGCTTCTTCGGCGGGTC | phosphorothioate | | | | x | | | 510 |
| 1000-1020 | GGACAAGGCGTGTCCAGGGA | phosphorothioate | | | | x | | | 511 |
| 1300-1320 | GCTGGGGTGACCGCAGCTCGC | phosphorothioate | | | | x | | | 512 |
| 1520-1540 | GATGAACTTCTTGGTGTTCCT | phosphorothioate | | | | x | | | 513 |
| 2110-2130 | GTGCGCCAGGCCCTGTGGATA | phosphorothioate | | | | x | | | 514 |

TABLE 2-continued

USEFUL OLIGONUCLEOTIDES

| primer | 5'-sequence-3'* | Notes | mismatch?* | seq | USE PCR | AS | CL | MUT | SEQ ID |
|---|---|---|---|---|---|---|---|---|---|
| 2295-2315 | GCCCATGGGCGGCCTTCTGGA | phosphorothioate | | | | x | | | 515 |
| 2450-2470 | GAGGCCACTGCTGGCCTCATT | phosphorothioate | | | | x | | | 516 |
| 2670-2690 | GGGTGAGGTGAGTGTCACCA | phosphorothioate | | | | x | | | 517 |
| 3080-3110 | GCTGCAGCACATGCGTGAAAACCTGTACGC | phosphorothioate | | | | x | | | 518 |
| 3140-3160 | GACGCGCAGGAAAAATGTGGG | phosphorothioate | | | | x | | | 519 |
| 3690-3710 | CCGAGCGCCAGCCTGTGGGGA | phosphorothioate | | | | x | | | 520 |
| 55-75 | CAGCGGGGAGCGCGCGGCATC | phosphorothioate | | | | x | | | 521 |
| 151-171 | CAGCACCTCGCGGTAGTGGCT | phosphorothioate | | | | x | | | 522 |
| TP1.1 | TCAAGCCAAACCTGAATCTGAG | | | | x | | | | 523 |
| TP1.2 | CCCGAGTGAATCTTTCTACGC | | | | x | | | | 524 |
| TP1.3 | GTCTCTGGCAGTTTCCTCATCCC | | | | x | | | | 525 |
| TP1.4 | TTTAGGCATCCTCCCAAGCACA | | | | | | | | 526 |

IV. TRT PROTEINS AND PEPTIDES

A) Generally

The invention provides a wide variety of hTRT proteins useful for, inter alia, production of telomerase activity, inhibition of telomerase activity in a cell, induction of an anti-hTRT immune response, as a therapeutic reagent, as a standard or control in a diagnostic assay, as a target in a screen for compounds capable of activation or inhibition of an activity of hTRT or telomerase, and numerous other uses that will be apparent to one of skill or are otherwise described herein. The hTRT of the invention include functionally active proteins (useful for e.g., conferring telomerase activity in a telomerase-negative cell) and variants, inactive variants (useful for e.g., inhibiting telomerase activity in a cell), hTRT polypeptides, and telomerase RNPs (e.g., ribonucleoprotein complexes comprising the proteins) that exhibit one, several, or all of the functional activities of naturally occurring hTRT and telomerase, as discussed in greater detail for illustrative purposes, below.

In one embodiment, the hTRT protein of the invention is a polypeptide having a sequence as set forth in FIG. 17 (SEQ ID NO:2), or a fragment thereof. In another embodiment, the hTRT polypeptide differs from SEQ ID NO:2 by internal deletions, insertions, or conservative substitutions of amino acid residues. In a related embodiment, the invention provides hTRT polypeptides with substantial similarity to SEQ ID NO:2. The invention further provides hTRT polypeptides that are modified, relative to the amino acid sequence of SEQ ID NO:2, in some manner, e.g., truncated, mutated, derivatized, or fused to other sequences (e.g., to form a fusion protein). Moreover, the present invention provides telomerase RNPs comprising an hTRT protein of the invention complexed with a template RNA (e.g., hTR). In other embodiments, one or more telomerase-associated proteins is associated with hTRT protein and/or hTR.

The invention also provides other naturally occurring hTRT species or nonnaturally occurring variants, such as proteins having the sequence of, or substantial similarity to SEQ ID NO:5 [[FIG. 20], SEQ ID NO:10 [FIG. 19], and fragments, variants, or derivatives thereof.

The invention provides still other hTRT species and variants. One example of an hTRT variant may result from ribosome frameshifting of mRNA encoded by the clone 712562 (SEQ ID NO:3 [FIG. 18]) or the pro90 variant hTRT shown in SEQ ID NO:4 [FIG. 20] and so result in the synthesis of hTRT polypeptides containing all the TRT motifs (for a general example, see, e.g., Tsuchihashi et al., 1990, *Proc. Natl. Acad. Sci. USA* 87:2516; Craigengen et al., 1987, *Cell* 50:1; Weiss, 1990, *Cell* 62:117). Ribosome frameshifting can occur when specific mRNA sequences or secondary structures cause the ribosome to "stall" and jump one nucleotide forwards or back in the sequence. Thus, a ribosome frameshift event on the 712562 mRNA could cause the synthesis of an approximately 523 amino acid residue polypeptide. A ribosome frameshift event on the pro90 sequence could result in a protein with approximately 1071 residues. It will be appreciated that proteins resulting from ribosome frameshifting can also be expressed by synthetic or recombinant techniques provided by the invention.

Human TRT proteins, peptides, and functionally equivalent proteins may be obtained by purification, chemical synthesis, or recombinant production, as discussed in greater detail below.

B) TRT Protein Activities

The TRT polypeptides of the invention (including fragments, variants, products of alternative alleles, and fusion proteins) can have one or more, or all of the functional activities associated with native hTRT. Except as noted, as used herein, an hTRT or other TRT polypeptide is considered to have a specified activity if the activity is exhibited by either the hTRT protein without an associated RNA (e.g., hTR) or in an hTRT-associated RNA (e.g., hTR) complex. The hTR-binding activity of hTRT is one example of an activity associated with the hTRT protein. Methods for producing complexes of nucleic acids (e.g., hTR) and the hTRT polypeptides of the invention are described infra.

Modification of the hTRT protein (e.g., by chemical or recombinant means, including mutation or modification of a polynucleotide encoding the hTRT polypeptide or chemical synthesis of a polynucleotide that has a sequence different than a native polynucleotide sequence) to have a different complement of activities than native hTRT can be useful in therapeutic applications or in screening for specific modulators of hTRT or telomerase activity. In addition, assays for various hTRT activities can be particularly useful for identification of agents (e.g., activity modulating agents) that interact with hTRT or telomerase to change telomerase activity.

The activities of native hTRT, as discussed infra, include telomerase catalytic activity (which may be either processive or non-processive activity); telomerase processivity; conventional reverse transcriptase activity; nucleolytic activity; primer or substrate (telomere or synthetic telomerase substrate or primer) binding activity; dNTP binding activity; RNA (i.e., hTR) binding activity; and protein binding activity (e.g., binding to telomerase-associated proteins, telomere-binding proteins, or to a protein-telomeric DNA complex). It will be understood, however, that present invention also provides hTRT compositions without any particular hTRT activity but with some useful activity related to the hTRT or other TRT proteins (e.g., certain typically short immunogenic peptides, inhibitory peptides).

1) Telomerase Catalytic Activity

As used herein, a polypeptide of the invention has "telomerase catalytic activity," when the polypeptide is capable of extending a DNA primer that functions as a telomerase substrate by adding a partial, one, or more than one repeat of a sequence (e.g., TTAGGG) encoded by a template nucleic acid (e.g., hTR). This activity may be processive or nonprocessive. Processive activity occurs when a telomerase RNP adds multiple repeats to a primer or telomerase before the DNA is released by the enzyme complex. Non-processive activity occurs when telomerase adds a partial, or only one, repeat to a primer and is then released. In vivo, however, a non-processive reaction could add multiple repeats by successive rounds of association, extension, and dissociation. This can occur in vitro as well, but it is not typically observed in standard assays due to the vastly large molar excess of primer over telomerase in standard assay conditions.

To characterize an hTRT polypeptide as having non-processive activity, a conventional telomerase reaction is performed using conditions that favor a non-processive reaction, for example high temperatures (i.e., 35-40EC, typically 37EC), low dGTP concentrations (1 µM or less), high primer concentrations (5 µM or higher), and high dATP/TTP concentrations (2 mM or higher), with the temperature and dGTP typically having the greatest effect. To characterize an hTRT polypeptide as having processive activity, a conventional telomerase reaction is performed using conditions that favor a processive reaction (for example, 27-34° C., typically 30° C.), high dGTP concentration (10 µM or higher), low primer concentration (1 µM or lower), and/or low dATP and TTP concentrations (0.3-1 mM) with temperature and dGTP typically concentration being the most critical. Alternatively, a TRAP assay (for processive or moderately processive activity) or the dot-blot and gel blot assays (for processive activity) may be used. The hTRT polypeptide of the invention can possess a non-processive activity, but not a processive activity (e.g., if an alteration of the hTRT polypeptide reduces or eliminates the ability to translocate), can be solely processive, or can possess both activities.

a) Non-Processive Activity

A non-processive telomerase catalytic activity can extend the DNA primer from the position where the 3' end anneals to the RNA template to the 5' end of the template sequence, typically terminating with the addition of the first G residue (as, for example, when the template is hTR). As shown below, the exact number of nucleotides added is dependent on the position of the 3' terminal nucleotide of the primer in the TTAGGG repeat sequence.

| NONPROCESSIVE ACTIVITY |
| --- |
| i) ---------TTAGGGttag (DNA) SEQ ID NO:527<br>3' -----AUCCCAAUC-----5' (RNA) |
| ii) ---------TTAGggttag (DNA) SEQ ID NO:527<br>3' AUCCCAAUC-------5' (RNA) |

In DNA, UC, = primer, lc = added nucleotides

Thus, 4 nucleotides are added to the—TTAGGG primer (i) while 6 nucleotides are added to the—TTAG primer (ii). The first repeat added by telomerase in a processive reaction is equivalent to this step; however, in a processive reaction telomerase performs a translocation step where the 3' end is released and re-bound at the 3' region of the template in a position sufficient to prime addition of another repeat (see Morin, 1997, *Eur. J. Cancer* 33:750).

A fully non-processive reaction produces only one band in a conventional assay using a single synthetic primer. Because this result could also be produced by other enzymes, such as a terminal transferase activity, it may be desirable in some applications to verify that the product is a result of a telomerase catalytic activity. A telomerase (comprising hTRT) generated band can be distinguished by several additional characteristics. The number of nucleotides added to the end of the primer should be consistent with the position of the primer 3' end. Thus, a—TTAGGG primer should have 4 nucleotides added and a—TTAG primer should have 6 nucleotides added (see above). In practice, two or more sequence permuted primers can be used which have the same overall length but different 5' and 3' endpoints. As an illustrative example, the non-processive extension of primers 5'-TTAGGGTTAGGGTTAGGG (SEQ ID NO:528) and 5'-GTTAGGGTTAGGGTTAGG (SEQ ID NO:529) will generate products whose absolute length will be one nucleotide different (4 added to 5'-TTAGGGT-TAGGGTTAGG (SEQ ID NO:528) for a 22 nt total length, and 5 added to 5'-GTTAGGGTTAGGGTTAGG (SEQ ID NO:529) for a 23 nt total length). The nucleotide dependence of the reaction should be consistent with the position of the primer terminus. Thus, a—TTAGGG primer product should require dGTP, TTP, and dATP, but not dCTP, and a—AGGGTT primer product should require dGTP and dATP, but not TTP or dCTP. The activity should be sensitive to RNAase or micrococcal nuclease pre-treatment (see Morin, 1989, *Cell* 59: 521) under conditions that will degrade hTR and so eliminate the template.

b) Processive Activity

In practice, a processive activity is easily observed by the appearance of a six nucleotide ladder in a conventional assay, TRAP assay, or gel-blot assay. A dot-blot assay can also be used, but no ladder is detected in such a method. The conventional assay is described in Morin, 1989, *Cell* 59:521, which is incorporated herein in its entirety and for all purposes. The TRAP assay is described in U.S. Pat. No. 5,629,154; see also, PCT publication WO 97/15687, PCT publication WO 95/13381; Krupp et al. Nucleic Acids Res., 1997, 25: 919; and Wright et al., 1995, *Nuc. Acids Res.* 23:3794, each of which is incorporated herein in its entirety and for all purposes. The dot blot immunoassay is described in detail in co-pending U.S. patent application Ser. No. 08/833,377, filed Apr. 14, 1997, which is incorporated herein by reference in its entirety and for all purposes. The dot blot assay can be used in a format in which a non-processive activity, which does not add the 3 or more repeats required for stable hybridization of the (CCCUAA)n probe used to detect the activity, is tested with compounds or hTRT variants to determine if the same generates processivity, i.e., if the probe detects an expected telomerase substrate, then the compound or mutant is able to change the non-processive activity to a processive activity. Other assays for processive telomerase catalytic activity can also be used, e.g., the stretch PCR assay of Tatematsu et al., 1996, *Oncogene* 13:2265. The gel-blot assay, a combination of the conventional and dot blot assays can also be used. In this variation a conventional assay is performed with no radiolabeled nucleotide and with high dGTP concentrations (e.g., 0.1-2 mM). After performing the conventional assay, the synthesized DNA is separated by denaturing PAGE and transferred to a membrane (e.g., nitrocellulose). Telomeric DNA (the product of telomerase—an extended telomerase primer or substrate) can then be detected by methods such as hybridization using labeled telomeric DNA probes (e.g., probes containing the CCCTAA sequence, as used in the dot blot assay, supra). An advantage of this technique is that it is more sensitive than the conventional assay and provides information about the size of the synthesized fragments and processivity of the reaction.

c) Activity Determinations

The telomerase activity of an hTRT polypeptide can be determined using an unpurified, partially purified or substantially purified hTRT polypeptide (e.g., in association with hTR), in vitro, or after expression in vivo. For example, telomerase activity in a cell (e.g., a cell expressing a recombinant hTRT polypeptide of the invention) can be assayed by detecting an increase or decrease in the length of telomeres. Typically assays for telomerase catalytic activity are carried out using an hTRT complexed with hTR; however, alternative telomerase template RNAs may be substituted, or one may conduct assays to measure another activity, such as telomerase-primer binding. Assays to determine the length of telomeres are known in the art and include hybridization of probes to telomeric DNA (an amplification step can be included) and TRF analysis i.e., the analysis of telomeric DNA restriction fragments [TRFs] following restriction endonuclease digestion, see PCT publications WO 93/23572 and WO 96/41016; Counter et al., 1992, *EMBO J.* 11:1921; Allsopp et al., 1992, *Proc. Nat'l. Acad. Sci. USA* 89:10114; Sanno, 1996, *Am J Clin Pathol* 106:16 and Sanno, 1997, *Neuroendocrinology* 65:299.

The telomerase catalytic activity of an hTRT polypeptide may be determined in a number of ways using the assays supra and other telomerase catalytic activity assays. According to one method, the hTRT protein is expressed (e.g., as described infra) in a telomerase negative human cell in which hTR is expressed (i.e., either normally in the cell or through recombinant expression), and the presence or absence of telomerase activity in the cell or cell lysate is determined. Examples of suitable telomerase-negative cells are IMR 90 (ATCC, #CCL-186) or BJ cells (human foreskin fibroblast line; see, e.g., Feng et al., 1995, *Science* 269: 1236). Other examples include retinal pigmented epithelial cells (RPE), human umbilical vein endothelial cells (HUVEC; ATCC #CRL-1730), human aortic endothelial cells (HAEC; Clonetics Corp, #CC-2535), and human mammary epithelial cells (HME; Hammond et al., 1984, *Proc. Nat'l. Acad. Sci. USA* 81:5435; Stampfer, 1985, *J Tissue Culture Methods* 9:107). In an alternative embodiment, the hTRT polypeptide is expressed (e.g., by transfection with an hTRT expression vector) in a telomerase positive cell, and an increase in telomerase activity in the cell compared to an untransfected control cell is detected if the polypeptide has telomerase catalytic activity. Usually the telomerase catalytic activity in a cell transfected with a suitable expression vector expressing hTRT will be significantly increased, such as at least about 2-fold, at least about 5-fold, or even at least about 10-fold to 100-fold or even 1000-fold higher than in untransfected (control) cells.

In an alternative embodiment, the hTRT protein is expressed in a cell (e.g., a telomerase negative cell in which hTR is expressed) as a fusion protein (see infra) having a label or an "epitope tag" to aid in purification. In one embodiment, the RNP is recovered from the cell using an antibody that specifically recognizes the tag. Preferred tags are typically short or small and may include a cleavage site or other property that allows the tag to be removed from the hTRT polypeptide. Examples of suitable tags include the Xpress™ epitope (Invitrogen, Inc., San Diego Calif.), and other moieties that can be specifically bound by an antibody or nucleic acid or other equivalent method such as those described in Example 6. Alternative tags include those encoded by sequences inserted, e.g., into SEQ ID NO:1 upstream of the ATG codon that initiates translation of the protein of SEQ ID NO:2, which may include insertion of a (new) methionine initiation codon into the upstream sequence.

It will be appreciated that when an hTRT variant is expressed in a cell (e.g., as a fusion protein) and subsequently isolated (e.g., as a ribonucleoprotein complex), other cell proteins (i.e., telomerase-associated proteins) may be associated with (directly or indirectly bound to) the isolated complex. In such cases, it will sometimes be desirable to assay telomerase activity for the complex containing hTRT, hTR and the associated proteins.

2) Other Telomerase or TRT Protein Activities

The hTRT polypeptides of the invention include variants that lack telomerase catalytic activity but retain one or more other activities of telomerase. These other activities and the methods of the invention for measuring such activities include (but are not limited to) those discussed in the following sections.

a) Conventional Reverse Transcriptase Activity

Telomerase conventional reverse transcriptase activity is described in, e.g., Morin, 1997, supra; and Spence et al., 1995, *Science* 267:988. Because hTRT contains conserved amino acid motifs that are required for reverse transcriptase catalytic activity, hTRT has the ability to transcribe certain exogenous (e.g., non-hTR) RNAs. A conventional RT assay measures the ability of the enzyme to transcribe an RNA template by extending an annealed DNA primer. Reverse transcriptase activity can be measured in numerous ways known in the art, for example, by monitoring the size increase of a labeled nucleic acid primer (e.g., RNA or DNA), or incorporation of a labeled dNTP. See, e.g., Ausubel et al., supra.

Because hTRT specifically associates with hTR, it can be appreciated that the DNA primer/RNA template for a conventional RT assay can be modified to have characteristics related to hTR and/or a telomeric DNA primer. For example, the RNA can have the sequence $(CCCTAA)_n$, where n is at least 1, or at least 3, or at least 10 or more (SEQ ID NO:530). In one embodiment, the $(CCCTAA)_n$ region is at or near the 5' terminus of the RNA (similar to the 5' locations of template regions in telomerase RNAs). Similarly, the DNA primer may have a 3' terminus that contains portions of the TTAGGG telomere sequence, for example $X_n$TTAG (SEQ ID NO:531), $X_n$AGGG (SEQ ID NO:532), $X_n(TTAGGG)_q$TTAG (SEQ ID NOS:533-536), etc., where X is a non-telomeric sequence and n is 8-20, or 6-30, and q is 1-4. In another embodiment, the DNA primer has a 5' terminus that is non-complementary to the RNA template, such that when the primer is annealed to the RNA, the 5' terminus of the primer remains unbound. Additional modifications of standard reverse transcription assays that may be applied to the methods of the invention are known in the art.

b) Nucleolytic Activity

Telomerase nucleolytic activity is described in e.g., Morin, 1997, supra; Collins and Grieder, 1993, *Genes and Development* 7:1364. Telomerase possesses a nucleolytic activity (Joyce and Steitz, 1987, *Trends Biochem. Sci.* 12:288); however, telomerase activity has defining characteristics. Telomerase preferentially removes nucleotides, usually only one, from the 3' end of an oligonucleotide when the 3' end of the DNA is positioned at the 5' boundary of the DNA template sequence, in humans and *Tetrahymena*, this nucleotide is the first G of the telomeric repeat (TTAGG in humans). Telomerase preferentially removes G residues but has nucleolytic activity against other nucleotides. This activity can be monitored. Two different methods are described here for illustrative purposes. One method involves a conventional telomerase reaction with a primer that binds the entire template sequence (i.e., terminating at the template boundary; 5'-TAGGGATTAG (SEQ ID NO:537) in humans). Nucleolytic activity is observed by monitoring the replacement of the last dG residue with a radiolabeled dGTP provided in the assay. The replacement is monitored by the appearance of a band at the size of the starting primer as shown by gel electrophoresis and autoradiography.

A preferred method uses a DNA primer that has a "blocked" 3' terminus that cannot be extended by telomerase. The 3'-blocked primer can be used in a standard telomerase assay but will not be extended unless the 3' nucleotide is removed by the nucleolytic activity of telomerase. The advantage of this method is that telomerase activity can be monitored by any of several standard means, and the signal is strong and easy to quantify. The blocking of the 3' terminus of the primer can be accomplished in several ways. One method is the addition of a 3'-deoxy-dNTP residue at the 3' terminus of the primer using standard oligonucleotide synthesis techniques. This terminus has a 2' OH but not the 3' OH required for telomerase. Other means of blocking the 3' terminus exist, for instance, a 3' dideoxy terminus, a 3'-amine terminus, and others. An example of a primer for an hTRT nucleolytic assay is 5'-TTAGGGT- TAGGGTTA ($G_{3'H}$) (SEQ ID NO:538) where the last residue denotes a 3'-deoxy-guanosine residue (Glen Research, Sterling, Va.). Numerous other variations for a suitable primer based on the disclosure are known to those of skill in the art.

c) Primer (Telomere) Binding Activity

Telomerase primer (telomere) binding activity is described in e.g., Morin, 1997, supra; Collins et al., 1995, *Cell* 81:677; Harrington et al, 1995, *J. Biol. Chem.* 270: 8893. Telomerase is believed to have two sites which bind a telomeric DNA primer. The RT motifs associated with primer binding indicate hTRT and/or hTRT/hTR possesses DNA primer binding activity. There are several ways of assaying primer binding activity; however, a step common to most methods is incubation of a labeled DNA primer with hTRT or hTRT/hTR or other TRT/TR combinations under appropriate binding conditions. Also, most methods employ a means of separating unbound DNA from protein-bound DNA; those methods include the following.

i) Gel-shift assays (also called electrophoretic/mobility shift assays) are those in which unbound DNA primer is separated from protein-bound DNA primer by electrophoresis on a nondenaturing gel (Ausubel et al., supra).

ii) Matrix binding assays include several variations to the basic technique, which involves binding the hTRT or hTRT/hTR complex to a matrix (e.g., nitrocellulose), either before or after incubation with the labeled primer. By binding the hTRT to a matrix, the unbound primer can be mechanically separated from bound primer. Residual unbound DNA can be removed by washing the membrane prior to quantitation. Those of skill recognize there are several means of coupling proteins to such matrices, solid supports, and membranes, including chemical, photochemical, UV cross-linking, antibody/epitope, and non-covalent (hydrophobic, electrostatic, etc.) interactions.

The DNA primer can be any DNA with an affinity for telomerase, such as, for example, a telomeric DNA primer like (TTAGGG)$_n$, where n could be 1-10 and is typically 3-5 (SEQ ID NO:539). The 3' and 5' termini can end in any location of the repeat sequence. The primer can also have 5' or 3' extensions of non-telomeric DNA that could facilitate labeling or detection. The primer can also be derivatized, e.g., to facilitate detection or isolation.

d) dNTP Binding Activity

Telomerase dNTP binding activity is described in e.g., Morin, 1997, supra; Spence et al., supra. Telomerase requires dNTPs to synthesize DNA. The hTRT protein has a nucleotide binding activity and can be assayed for dNTP binding in a manner similar to other nucleotide binding proteins (Kantrowitz et al., 1980, *Trends Biochem. Sci.* 5:124). Typically, binding of a labeled dNTP or dNTP analog can be monitored as is known in the art for non-telomerase RT proteins.

e) RNA (i.e., hTR) Binding Activity

Telomerase RNA (i.e., hTR) binding activity is described in e.g., Morin, 1997, supra; Harrington et al., 1997, *Science* 275:973; Collins et al., 1995, *Cell* 81:677. The RNA binding activity of a TRT protein of the invention may be assayed in a manner similar to the DNA primer binding assay described supra, using a labeled RNA probe. Methods for separating bound and unbound RNA and for detecting RNA are well known in the art and can be applied to the activity assays of the invention in a manner similar to that described for the DNA primer binding assay. The RNA can be full length hTR, fragments of hTR or other RNAs demonstrated to have an affinity for telomerase or hTRT. See U.S. Pat. No. 5,583,016 and PCT Pub. No. 96/40868.

3) Telomerase Motifs as Targets

The present invention, as noted supra, provides in addition to recombinant hTRT with a full complement (as described supra) of activities, hTRT polypeptides having less than the full complement of the telomerase activities of naturally occurring telomerase or hTRT or other TRT proteins. It will be appreciated that, in view of the disclosure herein of the RT and telomerase-specific motifs of TRT, alteration or mutation of conserved amino acid residues, such as are found in the motif sequences discussed supra, will result in loss-of activity mutants useful for therapeutic, drug screening and characterization, and other uses. For example, as described in Example 1, deletion of motifs B through D in the RT domains of the endogenous TRT gene in *S. pombe* resulted in haploid cells in which telomere progressively shortened to the point where hybridization of a telomere probe to telomeric repeats became almost undetectable, indicating a loss of telomerase catalytic activity. Similarly, alterations in the WxGxS (SEQ ID NO:540) site of motif E can affect telomerase DNA primer binding or function. Additionally, alterations of the amino acids in the motifs A, B', and C can affect the catalytic activity of telomerase. Mutation of the DD motif of hTRT can significantly reduce or abolish telomerase activity (see Example 16).

C) Synthesis of hTRT and Other TRT Polypeptides

The invention provides a variety of methods for making the hTRT and other TRT polypeptides disclosed herein. In the following sections, chemical synthesis and recombinant expression of hTRT proteins, including fusion proteins, is described in some detail.

1) Chemical Synthesis

The invention provides hTRT polypeptides synthesized, entirely or in part, using general chemical methods well known in the art (see e.g., Caruthers et al., 1980, *Nucleic Acids Res. Symp. Ser.,* 215-223; and Horn et al., 1980, *Nucleic Acids Res. Symp. Ser.,* 225-232). For example, peptide synthesis can be performed using various solid-phase techniques (Roberge, et al., 1995, *Science* 269:202), including automated synthesis (e.g., using the Perkin Elmer ABI 431A Peptide Synthesizer in accordance with the instructions provided by the manufacturer). When full length protein is desired, shorter polypeptides may be fused by condensation of the amino terminus of one molecule with the carboxyl terminus of the other molecule to form a peptide bond.

The newly synthesized peptide can be substantially purified, for example, by preparative high performance liquid chromatography (e.g., Creighton, PROTEINS, STRUCTURES AND MOLECULAR PRINCIPLES, WH Freeman and Co, New York N.Y. [1983]). The composition of the synthetic peptides (or any other peptides or polypeptides of the invention) may be confirmed by amino acid analysis or sequencing (e.g., the Edman degradation procedure; Creighton, supra). Importantly, the amino acid sequence of hTRT, or any part thereof, may be altered during direct synthesis and/or combined using chemical methods with sequences from other proteins or otherwise, or any part thereof or for any purpose, to produce a variant polypeptide of the invention.

2) Recombinant Expression of hTRT and Other TRT Proteins

The present invention provides methods, reagents, vectors, and cells useful for expression of hTRT polypeptides and nucleic acids using in vitro (cell-free), ex vivo or in vivo (cell or organism-based) recombinant expression systems. In one embodiment, expression of the hTRT protein, or fragment thereof, comprises inserting the coding sequence into an appropriate expression vector (i.e., a vector that contains the necessary elements for the transcription and translation of the inserted coding sequence required for the expression system employed). Thus, in one aspect, the invention provides for a polynucleotide substantially identical in sequence to an hTRT gene coding sequence at least 25 nucleotides, and preferably for many applications 50 to 100 nucleotides or more, of the hTRT cDNAs or genes of the invention, which is operably linked to a promoter to form a transcription unit capable of expressing an hTRT polypeptide. Methods well known to those skilled in the art can be used to construct the expression vectors containing an hTRT sequence and appropriate transcriptional or translational controls provided by the present invention (see, e.g., Sambrook et al., supra, Ausubel et al. supra, and this disclosure).

The hTRT polypeptides provided by the invention include fusion proteins that contain hTRT polypeptides or fragments of the hTRT protein. The fusion proteins are typically produced by recombinant means, although they may also be made by chemical synthesis. Fusion proteins can be useful in providing enhanced expression of the hTRT polypeptide constructs, or in producing hTRT polypeptides having other desirable properties, for example, comprising a label (such as an enzymatic reporter group), binding group, or antibody epitope. An exemplary fusion protein, comprising hTRT and enhanced green fluorescent protein (EGFP) sequences is described in Example 15, infra. It will be apparent to one of skill that the uses and applications discussed in Example 15 and elsewhere herein are not limited to the particular fusion protein, but are illustrative of the uses of various fusion constructs.

The fusion protein systems of the invention can also be used to facilitate efficient production and isolation of hTRT proteins or peptides. For example, in some embodiments, the non-hTRT sequence portion of the fusion protein comprises a short peptide that can be specifically bound to an immobilized molecule such that the fusion protein can be separated from unbound components (such as unrelated proteins in a cell lysate). One example is a peptide sequence that is bound by a specific antibody. Another example is a peptide comprising polyhistidine tracts e.g. $(His)_6$ or histidine-tryptophan sequences that can be bound by a resin containing nickel or copper ions (i.e., metal-chelate affinity chromatography). Other examples include Protein A domains or fragments, which allow purification on immobilized immunoglobulin, and the domain utilized in the FLAGS extension/affinity purification system (Immunex Corp, Seattle Wash.). In some embodiments, the fusion protein includes a cleavage site so that the hTRT or other TRT polypeptide sequence can be easily separated from the non-hTRT peptide or protein sequence. In this case, cleavage may be chemical (e.g., cyanogen bromide, 2-(2-nitrophenylsulphenyl)-3-methyl-3'-bromoindolene, hydroxylamine, or low pH) or enzymatic (e.g., Factor Xa, enterokinase). The choice of the fusion and cleavage systems may depend, in part, on the portion (i.e., sequence) of the hTRT polypeptide being expressed. Fusion proteins generally are described in Ausubel et al., supra, Ch. 16, Kroll et al., 1993, *DNA Cell. Biol.* 12:441, and the Invitrogen 1997 Catalog (Invitrogen Inc, San Diego Calif.). Other exemplary fusion proteins of the invention with epitope tags or tags and cleavage sites are provided in Example 6, infra.

It will be appreciated by those of skill that, although the expression systems discussed in this section are focused on expression of hTRT polypeptides, the same or similar cells, vectors and methods may be used to express hTRT polynucleotides of the invention, including sense and antisense polynucleotides without necessarily desiring production of hTRT polypeptides. Typically, expression of a polypeptide requires a suitable initiation codon (e.g., methionine), open reading frame, and translational regulatory signals (e.g., a ribosome binding site, a termination codon) which may be omitted when translation of a nucleic acid sequence to produce a protein is not desired.

Expression of hTRT polypeptides and polynucleotides may be carried out to accomplish any of several related benefits provided by the present invention. One illustrative benefit is expression of hTRT polypeptides that are subsequently isolated from the cell in which they are expressed (for example for production of large amounts of hTRT for use as a vaccine or in screening applications to identify compounds that modulate telomerase activity). A second illustrative benefit is expression of hTRT in a cell to change the phenotype of the cell (as in gene therapy applications). Nonmammalian cells can be used for expression of hTRT for purification, while eukaryotic especially mammalian cells (e.g., human cells) can be used not only for isolation and purification of hTRT but also for expression of hTRT when a change in phenotype in a cell is desired (e.g., to effect a change in proliferative capacity as in gene therapy applications). By way of illustration and not limitation, hTRT polypeptides having one or more telomerase activities (e.g. telomerase catalytic activity) can be expressed in a host cell to increase the proliferative capacity of a cell (e.g., immortalize a cell) and, conversely, hTRT antisense polynucleotides or inhibitory polypeptides typically can be expressed to reduce the proliferative capacity of a cell (e.g., of a telomerase positive malignant tumor cell). Numerous specific applications are described herein, e.g., in the discussion of uses of the reagents and methods of the invention for therapeutic applications, below.

Illustrative useful expression systems (cells, regulatory elements, vectors and expression) of the present invention include a number of cell-free systems such as reticulocyte lysate and wheat germ systems using hTRT polynucleotides in accordance with general methods well known in the art (see, e.g., Ausubel et al. supra at Ch. 10). In alternative embodiments, the invention provides reagents and methods for expressing hTRT in prokaryotic or eukaryotic cells. Thus, the present invention provides nucleic acids encoding hTRT polynucleotides, proteins, protein subsequences, or fusion proteins that can be expressed in bacteria, fungi, plant, insect, and animal, including human cell expression systems known in the art, including isolated cells, cell lines, cell cultures, tissues, and whole organisms. As will be understood by those of skill, the hTRT polynucleotides introduced into a host cell or cell free expression system will usually be operably linked to appropriate expression control sequences for each host or cell free system.

Useful bacterial expression systems include *E. coli*, bacilli (such as *Bacillus subtilus*), other enterobacteriaceae (such as *Salmonella, Serratia*, and various *Pseudomonas* species) or other bacterial hosts (e.g., *Streptococcus cremoris, Streptococcus lactis, Streptococcus thermophilus, Leuconostoc citrovorum, Leuconostoc mesenteroides, Lactobacillus acidophilus, Lactobacillus lactis, Bifidobacterium bifidum, Bifidobacteriu breve*, and *Bifidobacterium longum*). The hTRT expression constructs useful in prokaryotes include recombinant bacteriophage, plasmid or cosmid DNA expression vectors, or the like, and typically include promoter sequences. Illustrative promoters include inducible promoters, such as the lac promoter, the hybrid lacZ promoter of the Bluescript7 phagemid [Stratagene, La Jolla Calif.] or pSport1 [Gibco BRL]; phage lambda promoter systems; a tryptophan (trp) promoter system; and ptrp-lac hybrids and the like. Bacterial expression constructs optionally include a ribosome binding site and transcription termination signal regulatory sequences. Illustrative examples of specific vectors useful for expression include, for example, pTrcHis2, (Invitrogen, San Diego Calif.), pThioHis A, B & C, and numerous others known in the art or that may be developed (see, e.g. Ausubel). Useful vectors for bacteria include those that facilitate production of hTRT-fusion proteins. Useful vectors for high level expression of fusion proteins in bacterial cells include, but are not limited to, the multifunctional *E. coli* cloning and expression vectors such as Bluescript7 (Stratagene), noted above, in which the sequence encoding hTRT protein, an hTRT fusion protein or an hTRT fragment may be ligated into the vector in-frame with sequences for the amino-terminal Met and the subsequent 7 residues of β-galactosidase so that a hybrid protein is produced (e.g., pIN vectors; Van Heeke and Schuster, 1989, *J. Biol. Chem.*, 264:5503). Vectors such as pGEX vectors (e.g., pGEX-2TK; Pharmacia Biotech) may also be used to express foreign polypeptides, such as hTRT protein, as fusion proteins with glutathione S-transferase (GST). Such fusion proteins may be purified from lysed cells by adsorption to glutathione-agarose beads followed by elution in the presence of free glutathione. Proteins made in such systems often include enterokinase, thrombin or factor Xa protease cleavage sites so that the cloned polypeptide of interest can be released from the GST moiety at will, as may be useful in purification or other applications. Other examples are fusion proteins comprising hTRT and the *E. coli* Maltose Binding Protein (MBP) or *E. Coli* thioredoxin. Illustrative examples of hTRT expression constructs useful in bacterial cells are provided in Example 6, infra.

The invention further provides hTRT polypeptides expressed in fungal systems, such as *Dictyostelium* and, preferably, yeast, such as *Saccharomyces cerevisiae, Pichia pastoris, Torulopsis holmil, Saccharomyces fragilis, Saccharomyces lactis, Hansenula polymorpha* and *Candida pseudotropicalis*. When hTRT is expressed in yeast, a number of suitable vectors are available, including plasmid and yeast artificial chromosomes (YACs) vectors. The vectors typically include expression control sequences, such as constitutive or inducible promoters (e.g., such as alpha factor, alcohol oxidase, PGH, and 3-phosphoglycerate kinase or other glycolytic enzymes), and an origin of replication, termination sequences and the like, as desired. Suitable vectors for use in *Pichia* include pPICZ, His6/pPICZB, pPICZalpha, pPIC3.5K, pPIC9K, pA0815, pGAP2A, B & C, pGAP2alpha A, B, and C (Invitrogen, San Diego, Calif.) and numerous others known in the art or to be developed. In one embodiment, the vector His6/pPICZB (Invitrogen, San Diego, Calif.) is used to express a $His_6$-hTRT fusion protein in the yeast *Pichia pastoris*. An example of a vector useful in *Saccharomyces* is pYES2 (Invitrogen, San Diego, Calif.). Illustrative examples of hTRT expression constructs useful in yeast are provided in Example 6, infra.

The hTRT polypeptides of the invention may also be expressed in plant cell systems transfected with plant or plant virus expression vectors (e.g., cauliflower mosaic virus, CaMV; tobacco mosaic virus, TMV) or transformed with bacterial expression vectors (e.g., Ti or pBR322 plasmid). In cases where plant virus expression vectors are used, the expression of an hTRT-encoding sequence may be driven by any of a number of promoters.

For example, viral promoters such as the 35S and 19S promoters of CaMV (Brisson et al., 1984, *Nature* 310:511-514) may be used alone or in combination with the omega leader sequence from TMV (Takamatsu et al., 1987, *EMBO J.*, 6:307-311). Alternatively, plant promoters such as that from the small subunit gene of RUBISCO (Coruzzi et al., 1984, *EMBO J*, 3:1671-1680; Broglie et al., 1984, *Science* 224:838-843) or heat shock promoters (Winter and Sinibaldi, 1991, *Results Probl. Cell Differ.*, 17:85), or storage protein gene promoters may be used. These constructs can be introduced into plant cells by direct DNA transformation or pathogen-mediated transfection (for reviews of such techniques, see Hobbs or Murry, 1992, in MCGRAW HILL YEARBOOK OF SCIENCE AND TECHNOLOGY McGraw Hill New York N.Y., pp. 191-196 [1992]; or Weissbach and Weissbach, 1988, METHODS FOR PLANT MOLECULAR BIOLOGY, Academic Press, New York N.Y., pp. 421-463).

Another expression system provided by the invention for expression of hTRT protein is an insect system. A preferred system uses a baculovirus polyhedrin promoter. In one such system, *Autographa californica* nuclear polyhedrosis virus (AcNPV) is used as a vector to express foreign genes in *Spodoptera frugiperda* cells or in *Trichoplusia* larvae. The sequence encoding the gene of interest may be cloned into a nonessential region of the virus, such as the polyhedrin gene, and placed under control of the polyhedrin promoter. Successful insertion of the sequence, e.g., encoding the hTRT protein, will render the polyhedrin gene inactive and produce recombinant virus lacking coat protein. The recombinant viruses are then used to infect *S. frugiperda* cells or *Trichoplusia* larvae, in which the hTRT sequence is then expressed (see, for general methods, Smith et al., *J. Virol.*, 46:584 [1983]; Engelhard et al., Proc. Natl. Acad. Sci. 91:3224-7 [1994]). Useful vectors for baculovirus expression include pBlueBacHis2 A, B & C, pBlueBac4.5, pMe1BacB and numerous others known in the art or to be developed. Illustrative examples of hTRT expression constructs useful in insect cells are provided in Example 6, infra.

The present invention also provides expression systems in mammals and mammalian cells. As noted supra, hTRT polynucleotides may be expressed in mammalian cells (e.g., human cells) for production of significant quantities of hTRT polypeptides (e.g., for purification) or to change the phenotype of a target cell (e.g., for purposes of gene therapy, cell immortalization, or other). In the latter case, the hTRT polynucleotide expressed may or may not encode a polypeptide with a telomerase catalytic activity. That is, expression may be of a sense or antisense polynucleotide, an inhibitory or stimulatory polypeptide, a polypeptide with zero, one or more telomerase activities, and other combinations and variants disclosed herein or apparent to one of skill upon review of this disclosure.

Suitable mammalian host tissue culture cells for expressing the nucleic acids of the invention include any normal mortal or normal or abnormal immortal animal or human cell, including: monkey kidney CV1 line transformed by SV40 (COS-7, ATCC CRL 1651); human embryonic kidney line (293; Graham et al., *J. Gen. Virol.* 36:59 (1977)); baby hamster kidney cells (BHK, ATCC CCL 10); CHO (ATCC CCL 61 and CRL 9618); mouse sertoli cells (TM4, Mather, *Biol. Reprod.* 23:243-251 (1980)); monkey kidney cells (CV1 ATCC CCL 70); African green monkey kidney cells (VERO-76, ATCC CRL 1587); human cervical carcinoma cells (HeLa, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather, et al., *Annals N.Y Acad. Sci.* 383:44-46 (1982); MDCK cells (ATCC CCL 34 and CRL 6253); HEK 293 cells (ATCC CRL 1573); and WI-38 cells (ATCC CCL 75; ATCC: American Type Culture Collection, Rockville, Md.). The use of mammalian tissue cell culture to express polypeptides is discussed generally in Winnacker, FROM GENES TO CLONES (VCH Publishers, N.Y., N.Y., 1987).

For mammalian host cells, viral-based and nonviral expression systems are provided. Nonviral vectors and systems include plasmids and episomal vectors, typically with an expression cassette for expressing a protein or RNA, and human artificial chromosomes (see, e.g., Harrington et al., 1997, *Nat Genet* 15:345). For example, nonviral vectors useful for expression of hTRT polynucleotides and polypeptides in mammalian (e.g., human) cells include pcDNA3.1/His, pEBVHis A, B & C, (Invitrogen, San Diego Calif.), MPSV vectors, others described in the Invitrogen 1997 Catalog (Invitrogen Inc, San Diego Calif.), which is incorporated in its entirety herein, and numerous others known in the art for other proteins. Illustrative examples of hTRT expression constructs useful in mammalian cells are provided in Example 6, infra.

Useful viral vectors include vectors based on retroviruses, adenoviruses, adenoassociated viruses, herpes viruses, vectors based on SV40, papilloma virus, HBP Epstein Barr virus, vaccinia virus vectors and Semliki Forest virus (SFV). SFV and vaccinia vectors are discussed generally in Ausubel et al., supra, Ch 16. These vectors are often made up of two components, a modified viral genome and a coat structure surrounding it (see generally Smith, 1995, *Annu. Rev. Microbiol.* 49: 807), although sometimes viral vectors are introduced in naked form or coated with proteins other than viral proteins. However, the viral nucleic acid in a vector may be changed in many ways, for example, when designed for gene therapy. The goals of these changes are to disable growth of the virus in target cells while maintaining its ability to grow in vector form in available packaging or helper cells, to provide space within the viral genome for insertion of exogenous DNA sequences, and to incorporate new sequences that encode and enable appropriate expression of the gene of interest. Thus, vector nucleic acids generally comprise two components: essential cis-acting viral sequences for replication and packaging in a helper line and the transcription unit for the exogenous gene. Other viral functions are expressed in trans in a specific packaging or helper cell line. Adenoviral vectors (e.g., for use in human gene therapy) are described in, e.g., Rosenfeld et al., 1992, *Cell* 68: 143; PCT publications WO 94/12650; 94/12649; and 94/12629. In cases where an adenovirus is used as an expression vector, a sequence encoding hTRT may be ligated into an adenovirus transcription/translation complex consisting of the late promoter and tripartite leader sequence. Insertion in a nonessential E1 or E3 region of the viral genome will result in a viable virus capable of expressing in infected host cells (Logan and Shenk, 1984, *Proc. Natl. Acad. Sci.,* 81:3655). Replication-defective retroviral vectors harboring a therapeutic polynucleotide sequence as part of the retroviral genome are described in, e.g., Miller et al., 1990, *Mol. Cell. Biol.* 10: 4239; Kolberg, 1992, *J NIH Res.* 4: 43; and Cornetta et al., 1991, *Hum. Gene Ther.* 2: 215.

In mammalian cell systems, promoters from mammalian genes or from mammalian viruses are often appropriate. Suitable promoters may be constitutive, cell type-specific, stage-specific, and/or modulatable or regulatable (e.g., by hormones such as glucocorticoids). Useful promoters include, but are not limited to, the metallothionein promoter, the constitutive adenovirus major late promoter, the dexamethasone-inducible MMTV promoter, the SV40 promoter, the MRP polIII promoter, the constitutive MPSV promoter, the tetracycline-inducible CMV promoter (such as the human immediate-early CMV promoter), the constitutive CMV promoter, and promoter-enhancer combinations known in the art.

Other regulatory elements may also be required or desired for efficient expression of an hTRT polynucleotide and/or translation of a sequence encoding hTRT proteins. For translation, these elements typically include an ATG initiation codon and adjacent ribosome binding site or other sequences. For sequences encoding the hTRT protein, provided its initiation codon and upstream promoter sequences are inserted into an expression vector, no additional translational or other control signals may be needed. However, in cases where only coding sequence, or a portion thereof, is inserted, exogenous transcriptional and/or translational control signals (e.g., the promoter, ribosome-binding site, and ATG initiation codon) must often be provided. Furthermore, the initiation codon must typically be in the correct reading frame to ensure translation of the desired protein. Exogenous transcriptional elements and initiation codons can be of various origins, both natural and synthetic. In addition, the efficiency of expression may be enhanced by the inclusion of enhancers appropriate to the cell system in use (Scharf et al., 1994, *Results Probl. Cell Differ.* 20:125; and Bittner et al. 1987, *Meth. Enzymol.,* 153:516). For example, the SV40 enhancer or CMV enhancer may be used to increase expression in mammalian host cells.

Expression of hTRT gene products can also by effected (increased) by activation of an hTRT promoter or enhancer in a cell such as a human cell, e.g., a telomerase-negative cell line. Activation can be carried out in a variety of ways, including administration of an exogenous promoter activating agent, or inhibition of a cellular component that suppresses expression of the hTRT gene. It will be appreciated that, conversely, inhibition of promoter function, as described infra, will reduce hTRT gene expression.

The invention provides inducible and repressible expression of hTRT polypeptides using such system as the Ecdysone-Inducible Expression System (Invitrogen), and the Tet-On and Tet-off tetracycline regulated systems from Clontech. The ecdysone-inducible expression system uses the steroid hormone ecdysone analog, muristerone A, to activate expression of a recombinant protein via a heterodimeric nuclear receptor (No et al., 1996, *Proc. Natl. Acad. Sci. USA* 93:3346). In one embodiment of the invention, hTRT is cloned in the pIND vector (Clontech), which contains five modified ecdysone response elements (E/GREs) upstream of a minimal heat shock promoter and the multiple cloning site. The construct is then transfected in cell lines stably expressing the ecdysone receptor. After transfection, cells are treated with muristerone A to induce intracellular expression from pIND. In another embodiment of the invention, hTRT polypeptide is expressed using the Tet-on and Tet-off expression systems (Clontech) to provide regulated, high-level gene expression (Gossen et al., 1992, *Proc. Natl. Acad. Sci. USA* 89:5547; Gossen et al., 1995, *Science* 268:1766).

The hTRT vectors of the invention may be introduced into a cell, tissue, organ, patient or animal by a variety of methods. The nucleic acid expression vectors (typically dsDNA) of the invention can be transferred into the chosen host cell by well-known methods such as calcium chloride transformation (for bacterial systems), electroporation, calcium phosphate treatment, liposome-mediated transformation, injection and microinjection, ballistic methods, virosomes, immunoliposomes, polycation:nucleic acid conjugates, naked DNA, artificial virions, fusion to the herpes virus structural protein VP22 (Elliot and O'Hare, Cell 88:223), agent-enhanced uptake of DNA, and ex vivo transduction. Useful liposome-mediated DNA transfer methods are described in U.S. Pat. Nos. 5,049,386, U.S. Pat. No. 4,946,787; and U.S. Pat. No. 4,897,355; PCT publications WO 91/17424, WO 91/16024; Wang and Huang, 1987, *Biochem, Biophys. Res. Commun.* 147: 980; Wang and Huang, 1989, Biochemistry 28: 9508; Litzinger and Huang, 1992, *Biochem. Biophys. Acta* 1113:201; Gao and Huang, 1991, *Biochem, Biophys. Res. Commun.* 179: 280. Immunoliposomes have been described as carriers of exogenous polynucleotides (Wang and Huang, 1987, *Proc. Natl. Acad. Sci. U.S.A.* 84:7851; Trubetskoy et al., 1992, *Biochem. Biophys. Acta* 1131:311) and may have improved cell type specificity as compared to liposomes by virtue of the inclusion of specific antibodies which presumably bind to surface antigens on specific cell types. Behr et al., 1989, *Proc. Natl. Acad. Sci. U.S.A.* 86:6982 report using lipopolyamine as a reagent to mediate transfection itself, without the necessity of any additional phospholipid to form liposomes. Suitable delivery methods will be selected by practitioners in view of acceptable practices and regulatory requirements (e.g., for gene therapy or production of cell lines for expression of recombinant proteins). It will be appreciated that the delivery methods listed above may be used for transfer of nucleic acids into cells for purposes of gene therapy, transfer into tissue culture cells, and the like.

For long-term, high-yield production of recombinant proteins, stable expression will often be desired. For example, cell lines which stably express hTRT can be prepared using expression vectors of the invention which contain viral origins of replication or endogenous expression elements and a selectable marker gene. Following the introduction of the vector, cells may be allowed to grow for 1-2 days in an enriched media before they are switched to selective media. The purpose of the selectable marker is to confer resistance to selection, and its presence allows growth of cells which successfully express the introduced sequences in selective media. Resistant, stably transfected cells can be proliferated using tissue culture techniques appropriate to the cell type. An amplification step, e.g., by administration of methyltrexate to cells transfected with a DHFR gene according to methods well known in the art, can be included.

In addition, a host cell strain may be chosen for its ability to modulate the expression of the inserted sequences or to process the expressed protein in the desired fashion. Such modifications of the polypeptide include, but are not limited to, acetylation, carboxylation, phosphorylation, lipidation and acylation. Post-translational processing may also be important for correct insertion, folding and/or function. Different host cells have cellular machinery and characteristic mechanisms specific for each cell for such post-translational activities and so a particular cell may be chosen to ensure the correct modification and processing of the introduced, foreign protein.

As noted supra, when expressing an hTRT protein (including variants) in cells or organisms it is sometimes desirable to use an hTRT protein-encoding polynucleotide that employs a codon distribution other than that found in a naturally occurring hTRT gene. hTRT protein-encoding polynucleotides with alternative codons throughout, or at specific sites, in the coding sequence are used to optimize (e.g., increase) expression of the hTRT protein in cells, especially non-human cells (e.g., bacterial, plant, fungal, and non-human animal cells) which have different preferential codon usage than human cells. Codon changes may also be used to facilitate manipulation of the hTRT polynucleotide (e.g., by engineering useful tags or restriction sites into the coding sequence), and for other reasons. When the goal is to optimize expression (e.g., by increasing translational efficiency), tables of preferred codon usage, which are publicly available and are well known to those of skill, are used to design a suitable polynucleotide by "reverse translation" of the desired (e.g., hTRT) amino acid sequence. Alternatively, preferred codon usage can be determined for a particular organism (e.g., *Pichia pastoris*) or class of genes (e.g., highly expressed genes of a particular organism) by comparison of published gene sequences for the target organism or gene class.

Illustrative hTRT-encoding polynucleotide sequences are provided in Table 9 (A-E), infra. All of the sequences in Table 9 are in the 5'→3'. Table 9A shows an hTRT protein encoding polynucleotide that uses a codon distribution preferentially employed in the bacterium *E. coli*. Table 9B shows a second polynucleotide sequence particularly useful for expression in *E. coli* (and other enteric bacteria) using codons preferentially used in highly expressed genes in enteric bacteria. Table 4C shows an hTRT-protein encoding polynucleotide that uses a codon distribution preferentially employed in yeast (i.e., *S. cerevisiae*). Table 4D shows an hTRT protein encoding polynucleotide that uses a codon distribution preferentially used in highly expressed genes in yeast. Table 4E shows an hTRT protein encoding polynucleotide that uses a "generic" codon distribution that should be efficiently expressed in both bacteria (e.g., *E. coli*) and yeast (e.g., *S. pombe, S. cerevisiae, P. pastoris*) and some insect (e.g., *S. frugiperda*) cells. Such "generic" polynucleotide sequences (optimized for more than one organism) are useful for, for example, comparative studies, screening in different organisms of hTRT binding or modulatory agents, creation of shuttle vectors, and other uses. In this "generic" sequence, the codon TCT (serine) may not be optimal for expression in *Drosophila* cells. Therefore, in an alternative embodiment the sequence in Table 4E is modified to replace TCT with TCC for efficient expression in *Drosophila* as well as bacteria and yeast.

TABLE 9 hTRT-ENCODING POLYNUCLEOTIDE SEQUENCES EMPLOYING
ALTERNATIVE CODON DISTRIBUTIONS

Table 9A
*E. coli* (all genes) (SEQ ID NO:638)

ATG CCG CGC GCG CCG CGC TGC CGC GCG GTG CGC AGC CTG CTG CGC AGC CAT TAT

CGC GAA GTG CTG CCG CTG GCG ACC TTT GTG CGC CGC CTG GGC CCG CAG GGC TGG

TABLE 9-continued hTRT-ENCODING POLYNUCLEOTIDE SEQUENCES EMPLOYING ALTERNATIVE CODON DISTRIBUTIONS

```
CGC CTG GTG CAG CGC GGC GAT CCG GCG GCG TTT CGC GCG CTG GTG GCG CAG TGC
CTG GTG TGC GTG CCG TGG GAT GCG CGC CCG CCG CCG GCG GCG CCG AGC TTT CGC
CAG GTG AGC TGC CTG AAA GAA CTG GTG GCG CGC GTG CTG CAG CGC CTG TGC GAA
CGC GGC GCG AAA AAC GTG CTG GCG TTT GGC TTT GCG CTG CTG GAT GGC GCG CGC
GGC GGC CCG CCG GAA GCG TTT ACC ACC AGC GTG CGC AGC TAT CTG CCG AAC ACC
GTG ACC GAT GCG CTG CGC GGC AGC GGC GCG TGG GGC CTG CTG CTG CGC CGC GTG
GGC GAT GAT GTG CTG GTG CAT CTG CTG GCG CGC TGC GCG CTG TTT GTG CTG GTG
GCG CCG AGC TGC GCG TAT CAG GTG TGC GGC CCG CCG CTG TAT CAG CTG GGC GCG
GCG ACC CAG GCG CGC CCG CCG CCG CAT GCG AGC GGC CCG CGC CGC CGC CTG GGC
TGC GAA CGC GCG TGG AAC CAT AGC GTG CGC GAA GCG GGC GTG CCG CTG GGC CTG
CCG GCG CCG GGC GCG CGC CGC CGC GGC GGC AGC GCG AGC CGC AGC CTG CCG CTG
CCG AAA CGC CCG CGC CGC GGC GCG GCG CCG GAA CCG GAA CGC ACC CCG GTG GGC
CAG GGC AGC TGG GCG CAT CCG GGC CGC ACC CGC GGC CCG AGC GAT CGC GGC TTT
TGC GTG GTG AGC CCG GCG CGC CCG GCG GAA GAA GCG ACC AGC CTG GAA GGC GCG
CTG AGC GGC ACC CGC CAT AGC CAT CCG AGC GTG GGC CGC CAG CAT CAT GCG GGC
CCG CCG AGC ACC AGC CGC CCG CCG CGC CCG TGG GAT ACC CCG TGC CCG CCG GTG
TAT GCG GAA ACC AAA CAT TTT CTG TAT AGC AGC GGC GAT AAA GAA CAG CTG CGC
CCG AGC TTT CTG CTG AGC AGC CTG CGC CCG AGC CTG ACC GGC GCG CGC CGC CTG
GTG GAA ACC ATT TTT CTG GGC AGC CGC CCG TGG ATG CCG GGC ACC CCG CGC CGC
CTG CCG CGC CTG CCG CAG CGC TAT TGG CAG ATG CGC CCG CTG TTT CTG GAA CTG
CTG GGC AAC CAT GCG CAG TGC CCG TAT GGC GTG CTG CTG AAA ACC CAT TGC CCG
CTG CGC GCG GCG GTG ACC CCG GCG GCG GGC GTG TGC GCG CGC GAA AAA CCG CAG
GGC AGC GTG GCG GCG CCG GAA GAA GAA GAT ACC GAT CCG CGC CGC CTG GTG CAG
CTG CTG CGC CAG CAT AGC AGC CCG TGG CAG GTG TAT GGC TTT GTG CGC GCG TGC
CTG CGC CGC CTG GTG CCG CCG GGC CTG TGG GGC AGC CGC CAT AAC GAA CGC CGC
TTT CTG CGC AAC ACC AAA AAA TTT ATT AGC CTG GGC AAA CAT GCG AAA CTG AGC
CTG CAG GAA CTG ACC TGG AAA ATG AGC GTG CGC GAT TGC GCG TGG CTG CGC CGC
AGC CCG GGC GTG GGC TGC GTG CCG GCG GCG GAA CAT CGC CTG CGC GAA GAA ATT
CTG GCG AAA TTT CTG CAT TGG CTG ATG AGC GTG TAT GTG GTG GAA CTG CTG CGC
AGC TTT TTT TAT GTG ACC GAA ACC ACC TTT CAG AAA AAC CGC CTG TTT TTT TAT
CGC AAA AGC GTG TGG AGC AAA CTG CAG AGC ATT GGC ATT CGC CAG CAT CTG AAA
CGC GTG CAG CTG CGC GAA CTG AGC GAA GCG GAA GTG CGC CAG CAT CGC GAA GCG
CGC CCG GCG CTG CTG ACC AGC CGC CTG CGC TTT ATT CCG AAA CCG GAT GGC CTG
CGC CCG ATT GTG AAC ATG GAT TAT GTG GTG GGC GCG CGC ACC TTT CGC CGC GAA
AAA CGC GCG GAA CGC CTG ACC AGC CGC GTG AAA GCG CTG TTT AGC GTG CTG AAC
TAT GAA CGC GCG CGC CGC CCG GGC CTG CTG GGC GCG AGC GTG CTG GGC CTG GAT
GAT ATT CAT CGC GCG TGG CGC ACC TTT GTG CTG CGC GTG CGC GCG CAG GAT CCG
CCG CCG GAA CTG TAT TTT GTG AAA GTG GAT GTG ACC GGC GCG TAT GAT ACC ATT
```

TABLE 9-continued hTRT-ENCODING POLYNUCLEOTIDE SEQUENCES EMPLOYING ALTERNATIVE CODON DISTRIBUTIONS

```
CCG CAG GAT CGC CTG ACC GAA GTG ATT GCG AGC ATT ATT AAA CCG CAG AAC ACC
TAT TGC GTG CGC CGC TAT GCG GTG GTG CAG AAA GCG GCG CAT GGC CAT GTG CGC
AAA GCG TTT AAA AGC CAT GTG AGC ACC CTG ACC GAT CTG CAG CCG TAT ATG CGC
CAG TTT GTG GCG CAT CTG CAG GAA ACC AGC CCG CTG CGC GAT GCG GTG GTG ATT
GAA CAG AGC AGC AGC CTG AAC GAA GCG AGC AGC GGC CTG TTT GAT GTG TTT CTG
CGC TTT ATG TGC CAT CAT GCG GTG CGC ATT CGC GGC AAA AGC TAT GTG CAG TGC
CAG GGC ATT CCG CAG GGC AGC ATT CTG AGC ACC CTG CTG TGC AGC CTG TGC TAT
GGC GAT ATG GAA AAC AAA CTG TTT GCG GGC ATT CGC CGC GAT GGC CTG CTG CTG
CGC CTG GTG GAT GAT TTT CTG CTG GTG ACC CCG CAT CTG ACC CAT GCG AAA ACC
TTT CTG CGC ACC CTG GTG CGC GGC GTG CCG GAA TAT GGC TGC GTG GTG AAC CTG
CGC AAA ACC GTG GTG AAC TTT CCG GTG GAA GAT GAA GCG CTG GGC GGC ACC GCG
TTT GTG CAG ATG CCG GCG CAT GGC CTG TTT CCG TGG TGC GGC CTG CTG CTG GAT
ACC CGC ACC CTG GAA GTG CAG AGC GAT TAT AGC AGC TAT GCG CGC ACC AGC ATT
CGC GCG AGC CTG ACC TTT AAC CGC GGC TTT AAA GCG GGC CGC AAC ATG CGC CGC
AAA CTG TTT GGC GTG CTG CGC CTG AAA TGC CAT AGC CTG TTT CTG GAT CTG CAG
GTG AAC AGC CTG CAG ACC GTG TGC ACC AAC ATT TAT AAA ATT CTG CTG CTG CAG
GCG TAT CGC TTT CAT GCG TGC GTG CTG CAG CTG CCG TTT CAT CAG CAG GTG TGG
AAA AAC CCG ACC TTT TTT CTG CGC GTG ATT AGC GAT ACC GCG AGC CTG TGC TAT
AGC ATT CTG AAA GCG AAA AAC GCG GGC ATG AGC CTG GGC GCG AAA GGC GCG GCG
GGC CCG CTG CCG AGC GAA GCG GTG CAG TGG CTG TGC CAT CAG GCG TTT CTG CTG
AAA CTG ACC CGC CAT CGC GTG ACC TAT GTG CCG CTG CTG GGC AGC CTG CGC ACC
GCG CAG ACC CAG CTG AGC CGC AAA CTG CCG GGC ACC ACC CTG ACC GCG CTG GAA
GCG GCG GCG AAC CCG GCG CTG CCG AGC GAT TTT AAA ACC ATT CTG GAT
```

Table 9B
Enteric Bacteria (High Expressing Genes) (SEQ ID NO:639)

```
  1 ATGCCGCGTG CTCCGCGTTG CCGTGCTGTT CGTTCCCTGC TGCGTTCCCA
 51 CTACCGTGAA GTTCTGCCGC TGGCTACCTT CGTTCGTCGT CTGGGTCCGC
101 AGGGTTGGCG TCTGGTTCAG CGTGGTGACC CGGCTGCTTT CCGTGCTCTG
151 GTTGCTCAGT GCCTGGTTTG CGTTCCGTGG GACGCTCGTC CGCCGCCGGC
201 TGCTCCGTCC TTCCGTCAGG TTTCCTGCCT GAAAGAACTG GTTGCTCGTG
251 TTCTGCAGCG TCTGTGCGAA CGTGGTGCTA AAAACGTTCT GGCTTTCGGT
301 TTCGCTCTGC TGGACGGTGC TCGTGGTGGT CCGCCGGAAG CTTTCACCAC
351 CTCCGTTCGT TCCTACCTGC CGAACACCGT TACCGACGCT CTGCGTGGTT
401 CCGGTGCTTG GGGTCTGCTG CTGCGTCGTG TTGGTGACGA CGTTCTGGTT
451 CACCTGCTGG CTCGTTGCGC TCTGTTCGTT CTGGTTGCTC CGTCCTGCGC
501 TTACCAGGTT TGCGGTCCGC CGCTGTACCA GCTGGGTGCT GCTACCCAGG
551 CTCGTCCGCC GCCGCACGCT TCCGGTCCGC GTCGTCGTCT GGGTTGCGAA
601 CGTGCTTGGA ACCACTCCGT TCGTGAAGCT GGTGTTCCGC TGGGTCTGCC
651 GGCTCCGGGT GCTCGTCGTC GTGGTGGTTC CGCTTCCCGT TCCCTGCCGC
```

TABLE 9-continued hTRT-ENCODING POLYNUCLEOTIDE SEQUENCES EMPLOYING
ALTERNATIVE CODON DISTRIBUTIONS

```
 701 TGCCGAAACG TCCGCGTCGT GGTGCTGCTC CGGAACCGGA ACGTACCCCG
 751 GTTGGTCAGG GTTCCTGGGC TCACCCGGGT CGTACCCGTG GTCCGTCCGA
 801 CCGTGGTTTC TGCGTTGTTT CCCCGGCTCG TCCGGCTGAA GAAGCTACCT
 851 CCCTGGAAGG TGCTCTGTCC GGTACCCGTC ACTCCCACCC GTCCGTTGGT
 901 CGTCAGCACC ACGCTGGTCC GCCGTCCACC TCCCGTCCGC CGCGTCCGTG
 951 GGACACCCCG TGCCCGCCGG TTTACGCTGA AACCAAACAC TTCCTGTACT
1001 CCTCCGGTGA CAAAGAACAG CTGCGTCCGT CCTTCCTGCT GTCCTCCCTG
1051 CGTCCGTCCC TGACCGGTGC TCGTCGTCTG GTTGAAACCA TCTTCCTGGG
1101 TTCCCGTCCG TGGATGCCGG GTACCCCGCG TCGTCTGCCG CGTCTGCCGC
1151 AGCGTTACTG GCAGATGCGT CCGCTGTTCC TGGAACTGCT GGGTAACCAC
1201 GCTCAGTGCC CGTACGGTGT TCTGCTGAAA ACCCACTGCC CGCTGCGTGC
1251 TGCTGTTACC CCGGCTGCTG GTGTTTGCGC TCGTGAAAAA CCGCAGGGTT
1301 CCGTTGCTGC TCCGGAAGAA GAAGACACCG ACCCGCGTCG TCTGGTTCAG
1351 CTGCTGCGTC AGCACTCCTC CCCGTGGCAG GTTTACGGTT TCGTTCGTGC
1401 TTGCCTGCGT CGTCTGGTTC CGCCGGGTCT GTGGGGTTCC CGTCACAACG
1451 AACGTCGTTT CCTGCGTAAC ACCAAAAAAT TCATCTCCCT GGGTAAACAC
1501 GCTAAACTGT CCCTGCAGGA ACTGACCTGG AAAATGTCCG TTCGTGACTG
1551 CGCTTGGCTG CGTCGTTCCC CGGGTGTTGG TTGCGTTCCG GCTGCTGAAC
1601 ACCGTCTGCG TGAAGAAATC CTGGCTAAAT TCCTGCACTG GCTGATGTCC
1651 GTTTACGTTG TTGAACTGCT GCGTTCCTTC TTCTACGTTA CCGAAACCAC
1701 CTTCCAGAAA AACCGTCTGT TCTTCTACCG TAAATCCGTT TGGTCCAAAC
1751 TGCAGTCCAT CGGTATCCGT CAGCACCTGA AACGTGTTCA GCTGCGTGAA
1801 CTGTCCGAAG CTGAAGTTCG TCAGCACCGT GAAGCTCGTC CGGCTCTGCT
1851 GACCTCCCGT CTGCGTTTCA TCCCGAAACC GGACGGTCTG CGTCCGATCG
1901 TTAACATGGA CTACGTTGTT GGTGCTCGTA CCTTCCGTCG TGAAAAACGT
1951 GCTGAACGTC TGACCTCCCG TGTTAAAGCT CTGTTCTCCG TTCTGAACTA
2001 CGAACGTGCT CGTCGTCCGG GTCTGCTGGG TGCTTCCGTT CTGGGTCTGG
2051 ACGACATCCA CCGTGCTTGG CGTACCTTCG TTCTGCGTGT TCGTGCTCAG
2101 GACCCGCCGC CGGAACTGTA CTTCGTTAAA GTTGACGTTA CCGGTGCTTA
2151 CGACACCATC CCGCAGGACC GTCTGACCGA AGTTATCGCT TCCATCATCA
2201 AACCGCAGAA CACCTACTGC GTTCGTCGTT ACGCTGTTGT TCAGAAAGCT
2251 GCTCACGGTC ACGTTCGTAA AGCTTTCAAA TCCCACGTTT CCACCCTGAC
2301 CGACCTGCAG CCGTACATCC GTCAGTTCGT TGCTCACCTG CAGGAAACCT
2351 CCCCGCTGCG TGACGCTGTT GTTATCGAAC AGTCCTCCTC CCTGAACGAA
2401 GCTTCCTCCG GTCTGTTCGA CGTTTTCCTG CGTTTCATGT GCCACCACGC
2451 TGTTCGTATC CGTGGTAAAT CCTACGTTCA GTGCCAGGGT ATCCCGCAGG
2501 GTTCCATCCT GTCCACCCTG CTGTGCTCCC TGTGCTACGG TGACATGGAA
2551 AACAAACTGT TCGCTGGTAT CCGTCGTGAC GGTCTGCTGC TGCGTCTGGT
```

TABLE 9-continued hTRT-ENCODING POLYNUCLEOTIDE SEQUENCES EMPLOYING
ALTERNATIVE CODON DISTRIBUTIONS

```
2601 TGACGACTTC CTGCTGGTTA CCCCGCACCT GACCCACGCT AAAACCTTCC

2651 TGCGTACCCT GGTTCGTGGT GTTCCGGAAT ACGGTTGCGT TGTTAACCTG

2701 CGTAAAACCG TTGTTAACTT CCCGGTTGAA GACGAAGCTC TGGGTGGTAC

2751 CGCTTTCGTT CAGATGCCGG CTCACGGTCT GTTCCCGTGG TGCGGTCTGC

2801 TGCTGGACAC CCGTACCCTG GAAGTTCAGT CCGACTACTC CTCCTACGCT

2851 CGTACCTCCA TCCGTGCTTC CCTGACCTTC AACCGTGGTT TCAAAGCTGG

2901 TCGTAACATG CGTCGTAAAC TGTTCGGTGT TCTGCGTCTG AAATGCCACT

2951 CCCTGTTCCT GGACCTGCAG GTTAACTCCC TGCAGACCGT TTGCACCAAC

3001 ATCTACAAAA TCCTGCTGCT GCAGGCTTAC CGTTTCCACG CTTGCGTTCT

3051 GCAGCTGCCG TTCCACCAGC AGGTTTGGAA AAACCCGACC TTCTTCCTGC

3101 GTGTTATCTC CGACACCGCT TCCCTGTGCT ACTCCATCCT GAAAGCTAAA

3151 AACGCTGGTA TGTCCCTGGG TGCTAAAGGT GCTGCTGGTC CGCTGCCGTC

3201 CGAAGCTGTT CAGTGGCTGT GCCACCAGGC TTTCCTGCTG AAACTGACCC

3251 GTCACCGTGT TACCTACGTT CCGCTGCTGG GTTCCCTGCG TACCGCTCAG

3301 ACCCAGCTGT CCCGTAAACT GCCGGGTACC ACCCTGACCG CTCTGGAAGC

3351 TGCTGCTAAC CCGGCTCTGC CGTCCGACTT CAAAACCATC CTGGAC
```

Table 9C
Yeast (All Genes) (SEQ ID NO:640)

```
ATG CCA AGA GCT CCA AGA TGT AGA GCT GTT AGA TCT TTG TTG AGA TCT CAT TAT

AGA GAA GTT TTG CCA TTG GCT ACT TTT GTT AGA AGA TTG GGT CCA CAA GGT TGG

AGA TTG GTT CAA AGA GGT GAT CCA GCT GCT TTT AGA GCT TTG GTT GCT CAA TGT

TTG GTT TGT GTT CCA TGG GAT GCT AGA CCA CCA CCA GCT GCT CCA TCT TTT AGA

CAA GTT TCT TGT TTG AAA GAA TTG GTT GCT AGA GTT TTG CAA AGA TTG TGT GAA

AGA GGT GCT AAA AAT GTT TTG GCT TTT GGT TTT GCT TTG TTG GAT GGT GCT AGA

GGT GGT CCA CCA GAA GCT TTT ACT ACT TCT GTT AGA TCT TAT TTG CCA AAT ACT

GTT ACT GAT GCT TTG AGA GGT TCT GGT GCT TGG GGT TTG TTG TTG AGA AGA GTT

GGT GAT GAT GTT TTG GTT CAT TTG TTG GCT AGA TGT GCT TTG TTT GTT TTG GTT

GCT CCA TCT TCT GCT TAT CAA GTT TGT GGT CCA CCA TTG TAT CAA TTG GGT GCT

GCT ACT CAA GCT AGA CCA CCA CCA CAT GCT TCT GGT CCA AGA AGA AGA TTG GGT

TGT GAA AGA GCT TGG AAT CAT TCT GTT AGA GAA GCT GGT GTT CCA TTG GGT TTG

CCA GCT CCA GGT GCT AGA AGA AGA GGT GGT TCT GCT TCT AGA TCT TTG CCA TTG

CCA AAA AGA CCA AGA AGA GGT GCT GCT CCA GAA CCA GAA AGA ACT CCA GTT GGT

CAA GGT TCT TGG GCT CAT CCA GGT AGA ACT AGA GGT CCA TCT GAT AGA GGT TTT

TGT GTT GTT TCT CCA GCT AGA CCA GCT GAA GAA GCT ACT TCT TTG GAA GCT GCT

TTG TCT GGT ACT AGA CAT TCT CAT CCA TCT GTT GGT AGA CAA CAT CAT GCT GGT

CCA CCA TCT ACT TCT AGA CCA CCA AGA CCA TGG GAT ACT CCA TGT CCA CCA GTT
```

TABLE 9-continued hTRT-ENCODING POLYNUCLEOTIDE SEQUENCES EMPLOYING
ALTERNATIVE CODON DISTRIBUTIONS

```
TAT GCT GAA ACT AAA CAT TTT TTG TAT TCT TCT GGT GAT AAA GAA CAA TTG AGA
CCA TCT TTT TTG TTG TCT TCT TTG AGA CCA TCT TTG ACT GGT GCT AGA AGA TTG
GTT GAA ACT ATT TTT TTG GGT TCT AGA CCA TGG ATG CCA GGT ACT CCA AGA AGA
TTG CCA AGA TTG CCA CAA AGA TAT TGG CAA ATG AGA CCA TTG TTT TTG GAA TTG
TTG GGT AAT CAT GCT CAA TGT CCA TAT GGT GTT TTG TTG AAA ACT CAT TGT CCA
TTG AGA GCT GCT GTT ACT CCA GCT GCT GGT GTT TGT GCT AGA GAA AAA CCA CAA
GGT TCT GTT GCT GCT CCA GAA GAA GAA GAT ACT GAT CCA AGA AGA TTG GTT CAA
TTG TTG AGA CAA CAT TCT TCT CCA TGG CAA GTT TAT GGT TTT GTT AGA GCT TGT
TTG AGA AGA TTG GTT CCA CCA GGT TTG TGG GGT TCT AGA CAT AAT GAA AGA AGA
TTT TTG AGA AAT ACT AAA AAA TTT ATT TCT TTG GGT AAA CAT GCT AAA TTG TCT
TTG CAA GAA TTG ACT TGG AAA ATG TCT GTT AGA GAT TGT GCT TGG TTG AGA AGA
TCT CCA GGT GTT GGT TGT GTT CCA GCT GCT GAA CAT AGA TTG AGA GAA GAA ATT
TTG GCT AAA TTT TTG CAT TGG TTG ATG TCT GTT TAT GTT GTT GAA TTG TTG AGA
TCT TTT TTT TAT GTT ACT GAA ACT ACT TTT CAA AAA AAT AGA TTG TTT TTT TAT
AGA AAA TCT GTT TGG TCT AAA TTG CAA TCT ATT GGT ATT AGA CAA CAT TTG AAA
AGA GTT CAA TTG AGA GAA TTG TCT GAA GCT GAA GTT AGA CAA CAT AGA GAA GCT
AGA CCA GCT TTG TTG ACT TCT AGA TTG AGA TTT ATT CCA AAA CCA GAT GGT TTG
AGA CCA ATT GTT AAT ATG GAT TAT GTT GTT GGT GCT AGA ACT TTT AGA AGA GAA
AAA AGA GCT GAA AGA TTG ACT TCT AGA GTT AAA GCT TTG TTT TCT GTT TTG AAT
TAT GAA AGA GCT AGA AGA CCA GGT TTG TTG GGT GCT TCT GTT TTG GGT TTG GAT
GAT ATT CAT AGA GCT TGG AGA ACT TTT GTT TTG AGA GTT AGA GCT CAA GAT CCA
CCA CCA GAA TTG TAT TTT GTT AAA GTT GAT GTT ACT GGT GCT TAT GAT ACT ATT
CCA CAA GAT AGA TTG ACT GAA GTT ATT GCT TCT ATT ATT AAA CCA CAA AAT ACT
TAT TGT GTT AGA AGA TAT GCT GTT GTT CAA AAA GCT GCT CAT GGT CAT GTT AGA
AAA GCT TTT AAA TCT CAT GTT TCT ACT TTG ACT GAT TTG CAA CCA TAT ATG AGA
CAA TTT GTT GCT CAT TTG CAA GAA ACT TCT CCA TTG AGA GAT GCT GTT GTT ATT
GAA CAA TCT TCT TCT TTG AAT GAA GCT TCT TCT GGT TTG TTT GAT GTT TTT TTG
AGA TTT ATG TGT CAT CAT GCT GTT AGA ATT AGA GGT AAA TCT TAT GTT CAA TGT
CAA GGT ATT CCA CAA GGT TCT ATT TTG TCT ACT TTG TTG TGT TCT TTG TGT TAT
GGT GAT ATG GAA AAT AAA TTG TTT GCT GGT ATT AGA AGA GAT GGT TTG TTG TTG
AGA TTG GTT GAT GAT TTT TTG TTG GTT ACT CCA CAT TTG ACT CAT GCT AAA ACT
TTT TTG AGA ACT TTG GTT AGA GGT GTT CCA GAA TAT GGT TGT GTT GTT AAT TTG
AGA AAA ACT GTT GTT AAT TTT CCA GTT GAA GAT GAA GCT TTG GGT GGT ACT GCT
TTT GTT CAA ATG CCA GCT CAT GGT TTG TTT CCA TGG TGT GGT TTG TTG TTG GAT
ACT AGA ACT TTG GAA GTT CAA TCT GAT TAT TCT TCT TAT GCT AGA ACT TCT ATT
AGA GCT TCT TTG ACT TTT AAT AGA GGT TTT AAA GCT GGT AGA AAT ATG AGA AGA
AAA TTG TTT GGT GTT TTG AGA TTG AAA TGT CAT TCT TTG TTT TTG GAT TTG CAA
GTT AAT TCT TTG CAA ACT GTT TGT ACT AAT ATT TAT AAA ATT TTG TTG TTG CAA
```

TABLE 9-continued hTRT-ENCODING POLYNUCLEOTIDE SEQUENCES EMPLOYING ALTERNATIVE CODON DISTRIBUTIONS

```
GCT TAT AGA TTT CAT GCT TGT GTT TTG CAA TTG CCA TTT CAT CAA CAA GTT TGG
AAA AAT CCA ACT TTT TTT TTG AGA GTT ATT TCT GAT ACT GCT TCT TTG TGT TAT
TCT ATT TTG AAA GCT AAA AAT GCT GGT ATG TCT TTG GGT GCT AAA GGT GCT GCT
GGT CCA TTG CCA TCT GAA GCT GTT CAA TGG TTG TGT CAT CAA GCT TTT TTG TTG
AAA TTG ACT AGA CAT AGA GTT ACT TAT GTT CCA TTG TTG GGT TCT TTG AGA ACT
GCT CAA ACT CAA TTG TCT AGA AAA TTG CCA GGT ACT ACT TTG ACT GCT TTG GAA
GCT GCT GCT AAT CCA GCT TTG CCA TCT GAT TTT AAA ACT ATT TTG GAT
```

Table 9D
Yeast (High Expressing Genes) (SEQ ID NO:641)

```
ATG CCA AGA GCT CCA AGA TGT AGA GCT GTT AGA TCT TTG TTG AGA TCT CAC TAC
AGA GAA GTT TTG CCA TTG GCT ACT TTC GTT AGA AGA TTG GGT CCA CAA GGT TGG
AGA TTG GTT CAA AGA GGT GAC CCA GCT GCT TTC AGA GCT TTG GTT GCT CAA TGT
TTG GTT TGT GTT CCA TGG GAC GCT AGA CCA CCA CCA GCT GCT CCA TCT TTC AGA
CAA GTT TCT TGT TTG AAG GAA TTG GTT GCT AGA GTT TTG CAA AGA TTG TGT GAA
AGA GGT GCT AAG AAC GTT TTG GCT TTC GGT TTC GCT TTG TTG GAC GGT GCT AGA
GGT GGT CCA CCA GAA GCT TTC ACT ACT TCT GTT AGA TCT TAC TTG CCA AAC ACT
GTT ACT GAC GCT TTG AGA GGT TCT GGT GCT TGG GGT TTG TTG TTG AGA AGA GTT
GGT GAC GAC GTT TTG GTT CAC TTG TTG GCT AGA TGT GCT TTG TTC GTT TTG GTT
GCT CCA TCT TGT GCT TAC CAA GTT TGT GGT CCA CCA TTG TAC CAA TTG GGT GCT
GCT ACT CAA GCT AGA CCA CCA CCA CAC GCT TCT GGT CCA AGA AGA AGA TTG GGT
TGT GAA AGA GCT TGG AAC CAC TCT GTT AGA GAA GCT GGT GTT CCA TTG GGT TTG
CCA GCT CCA GGT GCT AGA AGA AGA GGT GGT TCT GCT TCT AGA TCT TTG CCA TTG
CCA AAG AGA CCA AGA AGA GGT GCT GCT CCA GAA CCA GAA AGA ACT CCA GTT GGT
CAA GGT TCT TGG GCT CAC CCA GGT AGA ACT AGA GGT CCA TCT GAC AGA GGT TTC
TGT GTT GTT TCT CCA GCT AGA CCA GCT GAA GAA GCT ACT TCT TTG GAA GGT GCT
TTG TCT GGT ACT AGA CAC TCT CAC CCA TCT GTT GGT AGA CAA CAC CAC GCT GGT
CCA CCA TCT ACT TCT AGA CCA CCA AGA CCA TGG GAC ACT CCA TGT CCA CCA GTT
TAC GCT GAA ACT AAG CAC TTC TTG TAC TCT TCT GGT GAC AAG GAA CAA TTG AGA
CCA TCT TTC TTG TTG TCT TCT TTG AGA CCA TCT TTG ACT GGT GCT AGA AGA TTG
GTT GAA ACT ATT TTC TTG GGT TCT AGA CCA TGG ATG CCA GGT ACT CCA AGA AGA
TTG CCA AGA TTG CCA CAA AGA TAC TGG CAA ATG AGA CCA TTG TTC TTG GAA TTG
TTG GGT AAC CAC GCT CAA TGT CCA TAC GGT GTT TTG TTG AAG ACT CAC TGT CCA
TTG AGA GCT GCT GTT ACT CCA GCT GCT GGT GTT TGT GCT AGA GAA AAG CCA CAA
GGT TCT GTT GCT GCT CCA GAA GAA GAA GAC ACT GAC CCA AGA AGA TTG GTT CAA
TTG TTG AGA CAA CAC TCT TCT CCA TGG CAA GTT TAC GGT TTC GTT AGA GCT TGT
TTG AGA AGA TTG GTT CCA CCA GGT TTG TGG GGT TCT AGA CAC AAC GAA AGA AGA
TTC TTG AGA AAC ACT AAG AAG TTC ATT TCT TTG GGT AAG CAC GCT AAG TTG TCT
TTG CAA GAA TTG ACT TGG AAG ATG TCT GTT AGA GAC TGT GCT TGG TTG AGA AGA
```

TABLE 9-continued hTRT-ENCODING POLYNUCLEOTIDE SEQUENCES EMPLOYING
ALTERNATIVE CODON DISTRIBUTIONS

TCT CCA GGT GTT GGT TGT GTT CCA GCT GCT GAA CAC AGA TTG AGA GAA GAA ATT

TTG GCT AAG TTC TTG CAC TGG TTG ATG TCT GTT TAC GTT GTT GAA TTG TTG AGA

TCT TTC TTC TAC GTT ACT GAA ACT ACT TTC CAA AAG AAC AGA TTG TTC TTC TAC

AGA AAG TCT GTT TGG TCT AAG TTG CAA TCT ATT GGT ATT AGA CAA CAC TTG AAG

AGA GTT CAA TTG AGA GAA TTG TCT GAA GCT GAA GTT AGA CAA CAC AGA GAA GCT

AGA CCA GCT TTG TTG ACT TCT AGA TTG AGA TTC ATT CCA AAG CCA GAC GGT TTG

AGA CCA ATT GTT AAC ATG GAC TAC GTT GTT GGT GCT AGA ACT TTC AGA AGA GAA

AAG AGA GCT GAA AGA TTG ACT TCT AGA GTT AAG GCT TTG TTC TCT GTT TTG AAC

TAC GAA AGA GCT AGA AGA CCA GGT TTG TTG GGT GCT TCT GTT TTG GGT TTG GAC

GAC ATT CAC AGA GCT TGG AGA ACT TTC GTT TTG AGA GTT AGA GCT CAA GAC CCA

CCA CCA GAA TTG TAC TTC GTT AAG GTT GAC GTT ACT GGT GCT TAC GAC ACT ATT

CCA CAA GAC AGA TTG ACT GAA GTT ATT GCT TCT ATT ATT AAG CCA CAA AAC ACT

TAC TGT GTT AGA AGA TAC GCT GTT GTT CAA AAG GCT GCT CAC GGT CAC GTT AGA

AAG GCT TTC AAG TCT CAC GTT TCT ACT TTG ACT GAC TTG CAA CCA TAC ATG AGA

CAA TTC GTT GCT CAC TTG CAA GAA ACT TCT CCA TTG AGA GAC GCT GTT GTT ATT

GAA CAA TCT TCT TCT TTG AAC GAA GCT TCT TCT GGT TTG TTC GAC GTT TTC TTG

AGA TTC ATG TGT CAC CAC GCT GTT AGA ATT AGA GGT AAG TCT TAC GTT CAA TGT

CAA GGT ATT CCA CAA GGT TCT ATT TTG TCT ACT TTG TTG TGT TCT TTG TGT TAC

GGT GAC ATG GAA AAC AAG TTG TTC GCT GGT ATT AGA AGA GAC GGT TTG TTG TTG

AGA TTG GTT GAC GAC TTC TTG TTG GTT ACT CCA CAC TTG ACT CAC GCT AAG ACT

TTC TTG AGA ACT TTG GTT AGA GGT GTT CCA GAA TAC GGT TGT GTT GTT AAC TTG

AGA AAG ACT GTT GTT AAC TTC CCA GTT GAA GAC GAA GCT TTG GGT GGT ACT GCT

TTC GTT CAA ATG CCA GCT CAC GGT TTG TTC CCA TGG TGT GGT TTG TTG TTG GAC

ACT AGA ACT TTG GAA GTT CAA TCT GAC TAC TCT TCT TAC GCT AGA ACT TCT ATT

AGA GCT TCT TTG ACT TTC AAC AGA GGT TTC AAG GCT GGT AGA AAC ATG AGA AGA

AAG TTG TTC GGT GTT TTG AGA TTG AAG TGT CAC TCT TTG TTC TTG GAC TTG CAA

GTT AAC TCT TTG CAA ACT GTT TGT ACT AAC ATT TAC AAG ATT TTG TTG TTG CAA

GCT TAC AGA TTC CAC GCT TGT GTT TTG CAA TTG CCA TTC CAC CAA CAA GTT TGG

AAG AAC CCA ACT TTC TTC TTG AGA GTT ATT TCT GAC ACT GCT TCT TTG TGT TAC

TCT ATT TTG AAG GCT AAG AAC GCT GGT ATG TCT TTG GGT GCT AAG GGT GCT GCT

GGT CCA TTG CCA TCT GAA GCT GTT CAA TGG TTG TGT CAC CAA GCT TTC TTG TTG

AAG TTG ACT AGA CAC AGA GTT ACT TAC GTT CAA TTG TTG GGT TCT TTG AGA ACT

GCT CAA ACT CAA TTG TCT AGA AAG TTG CCA GGT ACT ACT TTG ACT GCT TTG GAA

GCT GCT GCT AAC CCA GCT TTG CCA TCT GAC TTC AAG ACT ATT TTG GAC

Table 9E
"Generic" hTRT Protein Encoding Sequence (SEQ ID NO:642)

ATG CCA CGT GCC CCA CGT TGT CGT GCC GTT CGT TCT TTG TTG CGT TCT CAC TAC CGT

GAA GTT TTG CCA TTG GCC ACC TTC GTT CGT CGT TTG GGT CCA CAA GGT TGG CGT TTG

GTT CAA CGT GGT GAT CCA GCC GCC TTC CGT GCC TTG GTT GCC CAA TGT TTG GTT TGT

TABLE 9-continued hTRT-ENCODING POLYNUCLEOTIDE SEQUENCES EMPLOYING ALTERNATIVE CODON DISTRIBUTIONS

```
GTT CAA TGG GAT GCC CGT CCA CCA CCA GCC GCC CCA TCT TTC CGT CAA GTT TCT TGT
TTG AAA GAA TTG GTT GCC CGT GTT TTG CAA CGT TTG TGT GAA CGT GGT GCC AAA AAC
GTT TTG GCC TTC GGT TTC GCC TTG TTG GAT GGT GCC CGT GGT GGT CCA CCA GAA GCC
TTC ACC ACC TCT GTT CGT TCT TAC TTG CCA AAC ACC GTT ACC GAT GCC TTG CGT GGT
TCT GGT GCC TGG GGT TTG TTG TTG CGT CGT GTT GGT GAT GAT GTT TTG GTT CAC TTG
TTG GCC CGT TGT GCC TTG TTC GTT TTG GTT GCC CCA TCT TGT GCC TAC CAA GTT TGT
GGT CCA CCA TTG TAC CAA TTG GGT GCC GCC ACC CAA GCC CGT CCA CCA CCA CAC GCC
TCT GGT CCA CGT CGT CGT TTG GGT TGT GAA CGT GCC TGG AAC CAC TCT GTT CGT GAA
GCC GGT GTT CCA TTG GGT TTG CCA GCC CCA GGT GCC CGT CGT CGT GGT GGT TCT GCC
TCT CGT TCT TTG CCA TTG CCA AAA CGT CCA CGT CGT GGT GCC GCC CCA GAA CCA GAA
CGT ACC CCA GTT GGT CAA GGT TCT TGG GCC CAC CCA GGT CGT ACC CGT GGT CCA TCT
GAT CGT GGT TTC TGT GTT GTT TCT CCA GCC CGT CCA GCC GAA GAA GCC ACC TCT TTG
GAA GGT GCC TTG TCT GGT ACC CGT CAC TCT CAC CCA TCT GTT GGT CGT CAA CAC CAC
GCC GGT CCA CCA TCT ACC TCT CGT CCA CCA CGT CCA TGG GAT ACC CCA TGT CCA CCA
GTT TAC GCC GAA ACC AAA CAC TTC TTG TAC TCT TCT GGT GAT AAA GAA CAA TTG CGT
CCA TCT TTC TTG TTG TCT TCT TTG CGT CCA TCT TTG ACC GGT GCC CGT CGT TTG GTT
GAA ACC ATT TTC TTG GGT TCT CGT CCA TGG ATG CCA GGT ACC CCA CGT CGT TTG CCA
CGT TTG CCA CAA CGT TAC TGG CAA ATG CGT CCA TTG TTC TTG GAA TTG TTG GGT AAC
CAC GCC CAA TGT CCA TAC GGT GTT TTG TTG AAA ACC CAC TGT CCA TTG CGT GCC GCC
GTT ACC CCA GCC GCC GGT GTT TGT GCC CGT GAA AAA CCA CAA GGT TCT GTT GCC GCC
CCA GAA GAA GAA GAT ACC GAT CCA CGT CGT TTG GTT CAA TTG TTG CGT CAA CAC TCT
TCT CCA TGG CAA GTT TAC GGT TTC GTT CGT GCC TGT TTG CGT CGT TTG GTT CCA CCA
GGT TTG TGG GGT TCT CGT CAC AAC GAA CGT CGT TTC TTG CGT AAC ACC AAA AAA TTC
ATT TCT TTG GGT AAA CAC GCC AAA TTG TCT TTG CAA GAA TTG ACC TGG AAA ATG TCT
GTT CGT GAT TGT GCC TGG TTG CGT CGT TCT CCA GGT GTT GGT TGT GTT CCA GCC GCC
GAA CAC CGT TTG CGT GAA GAA ATT TTG GCC AAA TTC TTG CAC TGG TTG ATG TCT GTT
TAC GTT GTT GAA TTG TTG CGT TCT TTC TTC TAC GTT ACC GAA ACC ACC TTC CAA AAA
AAC CGT TTG TTC TTC TAC CGT AAA TCT GTT TGG TCT AAA TTG CAA TCT ATT GGT ATT
CGT CAA CAC TTG AAA CGT GTT CAA TTG CGT GAA TTG TCT GAA GCC GAA GTT CGT CAA
CAC CGT GAA GCC CGT CCA GCC TTG TTG ACC TCT CGT TTG CGT TTC ATT CCA AAA CCA
GAT GGT TTG CGT CCA ATT GTT AAC ATG GAT TAC GTT GTT GGT GCC CGT ACC TTC CGT
CGT GAA AAA CGT GCC GAA CGT TTG ACC TCT CGT GTT AAA GCC TTG TTC TCT GTT TTG
AAC TAC GAA CGT GCC CGT CGT CCA GGT TTG TTG GGT GCC TCT GTT TTG GGT TTG GAT
GAT ATT CAC CGT GCC TGG CGT ACC TTC GTT TTG CGT GTT CGT GCC CAA GAT CCA CCA
CCA GAA TTG TAC TTC GTT AAA GTT GAT GTT ACC GGT GCC TAC GAT ACC ATT CCA CAA
GAT CGT TTG ACC GAA GTT ATT GCC TCT ATT ATT AAA CCA CAA AAC ACC TAC TGT GTT
CGT CGT TAC GCC GTT GTT CAA AAA GCC GCC CAC GGT CAC GTT CGT AAA GCC TTC AAA
TCT CAC GTT TCT ACC TTG ACC GAT TTG CAA CCA TAC ATG CGT CAA TTC GTT GCC CAC
```

TABLE 9-continued

| hTRT-ENCODING POLYNUCLEOTIDE SEQUENCES EMPLOYING ALTERNATIVE CODON DISTRIBUTIONS |
| --- |
| TTG CAA GAA ACC TCT CCA TTG CGT GAT GCC GTT GTT ATT GAA CAA TCT TCT TCT TTG |
| AAC GAA GCC TCT TCT GGT TTG TTC GAT GTT TTC TTG CGT TTC ATG TGT CAC CAC GCC |
| GTT CGT ATT CGT GGT AAA TCT TAC GTT CAA TGT CAA GGT ATT CCA CAA GGT TCT ATT |
| TTG TCT ACC TTG TTG TGT TCT TTG TGT TAC GGT GAT ATG GAA AAC AAA TTG TTC GCC |
| GGT ATT CGT CGT GAT GGT TTG TTG TTG CGT TTG GTT GAT GAT TTC TTG TTG GTT ACC |
| CCA CAC TTG ACC CAC GCC AAA ACC TTC TTG CGT ACC TTG GTT CGT GGT GTT CCA GAA |
| TAC GGT TGT GTT GTT AAC TTG CGT AAA ACC GTT GTT AAC TTC CCA GTT GAA GAT GAA |
| GCC TTG GGT GGT ACC GCC TTC GTT CAA ATG CCA GCC CAC GGT TTG TTC CCA TGG TGT |
| GGT TTG TTG TTG GAT ACC CGT ACC TTG GAA GTT CAA TCT GAT TAC TCT TCT TAC GCC |
| CGT ACC TCT ATT CGT GCC TCT TTG ACC TTC AAC CGT GGT TTC AAA GCC GGT CGT AAC |
| ATG CGT CGT AAA TTG TTC GGT GTT TTG CGT TTG AAA TGT CAC TCT TTG TTC TTG GAT |
| TTG CAA GTT AAC TCT TTG CAA ACC GTT TGT ACC AAC ATT TAC AAA ATT TTG TTG TTG |
| CAA GCC TAC CGT TTC CAC GCC TGT GTT TTG CAA TTG CCA TTC CAC CAA CAA GTT TGG |
| AAA AAC CCA ACC TTC TTC TTG CGT GTT ATT TCT GAT ACC GCC TCT TTG TGT TAC TCT |
| ATT TTG AAA GCC AAA AAC GCC GGT ATG TCT TTG GGT GCC AAA GGT GCC GCC GGT CCA |
| TTG CCA TCT GAA GCC GTT CAA TGG TTG TGT CAC CAA GCC TTC TTG TTG AAA TTG ACC |
| CGT CAC CGT GTT ACC TAC GTT CCA TTG TTG GGT TCT TTG CGT ACC GCC CAA ACC CAA |
| TTG TCT CGT AAA TTG CCA GGT ACC ACC TTG ACC GCC TTG GAA GCC GCC GCC AAC CCA |
| GCC TTG CCA TCT GAT TTC AAA ACC ATT TTG GAT |

Following determination of the desired nucleotide sequence for the hTRT protein-encoding polynucleotide, the polynucleotide can be made by any suitable method including de novo chemical synthesis, directed mutagenesis of a synthetic or naturally occurring TRT gene or cDNA, or a combination of these methods. In one exemplary embodiment, oligonucleotides (typically 50-100 bases in length) are synthesized with a 5' phosphate group and include approximately 10-base overhangs (relative to adjacent oligonucleotides in the assembled gene) to direct subsequent ligations. Following purification and desalting, each oligonucleotide is annealed to its complement (e.g., by combining pairs of oligonucleotides in equimolar amounts in a neutral pH buffer with 50-200 mM NaCl and 0.5 mM $MgCl_2$). Annealing may be monitored by native PAGE. The resulting double-stranded oligonucleotides are ligated to their neighbors in pairs. After each ligation the products are gel-purified, then ligated to the appropriate (neighboring) double-stranded DNAs. In this manner, fragments of approximately 600-800 basepairs are built up. These intermediate fragments are then cloned into vectors and sequenced. The fragments are then combined into a single vector (resulting in a vector containing a polynucleotide with the desired hTRT protein-encoding sequence). This step is facilitated by using restriction sites present in, or engineered into, the polynucleotide sequence. Alternatively, the fragments can be built up by ligation until the complete cDNA is assembled and the assembled sequence cloned into a vector. Numerous other alternative methods and approaches will be apparent to those of skill in the art.

Table 10A shows an exemplary set of oligonucleotides that can be used to produce a polynucleotide, shown in Table 10B, that employs a codon distribution preferentially used by highly expressed genes in *E. coli*. The sequence in Table SB contains silent changes to some codons to introduce useful restriction sites spaced every 300-800 base pairs, to facilitate subcloning and modification. Oligonucleotide pairs for the initial annealing steps are indicated by the labels "T" (top strand) and "B" (bottom strand). The full-length polynucleotide (Table 10B) encodes the hTRT protein (with the start codon at nucleotides 28-30) and contains Sac I and Xho I sites at the termini flanking the open reading frame, which are useful for cloning into a variety of vectors (e.g., pBluescript II KS, Stratagene Inc., San Diego Calif.). Ones cloned into an appropriate vector, the hTRT sequence may be expressed, modified (e.g., by site directed or cassette mutagenesis), subcloned, or otherwise used or manipulated. In one embodiment, the polynucleotide is subcloned into a pET vector containing a T7 RNA polymerase promoter (Novagen Inc., Madison, Wis.) and introduced into an *E. coli* strain having an inducible T7 polymerase (Novagen Inc., Madison, Wis.). One advantage to the pET system is that the *E. coli* culture may be grown before the T7 RNA polymerase gene is induced, resulting in very high levels of transcription and minimizing the effect of any potential detrimental effect of the expressed protein on the cells.

TABLE 10

SYNTHESIS OF hTRT POLYNUCLEOTIDE HAVING ALTERNATIVE CODON DISTRIBUTION

Table 10A: Oligonucleotides (SEQ ID NOS:643-721)

| | |
|---|---|
| 1B | CCAGCGGCAGAACTTCGCGATAGTGGGAACGCAGCAGGGAACGAACAGCACGGCAACGCG GAGCACGCGGCATATGGTCGACTCTAGAGCTCCCGCGTGC |
| 1T | GCACGCGGGAGCTCTAGAGTCGACCATATGCCGCGTGCTCCGCGTTGCCGTGCTGTTCGTTC CCTGCTGCGTTCCCACTATCGCGAAGTT |
| 2B | GGCACTGAGCAACCAGAGCACGGAAAGCAGCCGGGTCACCACGCTGAACCAGACGCCAAC CCTGCGGGCCCAGACGACGAACGAAGGTAG |
| 2T | CTGCCGCTGGCTACCTTCGTTCGTCGTCTGGGCCCGCAGGGTTGGCGTCTGGTTCAGCGTGG TGACCCGGCTGCTTTCCGTGCTCTGGTT |
| 3B | GAACACGAGCAACCAGTTCTTTCAGGCAGGAAACCTGACGGAAGGACGGAGCAGCCGGCG GCGGACGAGCGTCCCACGGAACGCAAACCA |
| 3T | GCTCAGTGCCTGGTTTGCGTTCCGTGGGACGCTCGTCCGCCGCCGGCTGCTCCGTCCTTCCGT CAGGTTTCCTGCCTGAAAGAACTGGTT |
| 4B | ATGCTTCCGGCGGACCACCACGAGCACCGTCCAGCAGAGCGAAACCGAAAGCCAGAACGTT TTTAGCACCACGTTCGCACAGACGCTGCA |
| 4T | GCTCGTGTTCTGCAGCGTCTGTGCGAACGTGGTGCTAAAAACGTTCTGGCTTTCGGTTTCGC TCTGCTGGACGGTGCTCGTGGTGGTCCG |
| 5B | CAACACGACGCAGCAGCAGACCCCAAGCACCGGAACCACGCAGAGCGTCGGTAACGGTGTT CGGCAGGTAGGAACGAACGGAGGTGGTGA |
| 5T | CCGGAAGCATTCACCACCTCCGTTCGTTCCTACCTGCCGAACACCGTTACCGACGCTCTGCG TGGTTCCGGTGCTTGGGGTCTGCTGCTG |
| 6B | GCGGCGGACCACAAACCTGGTAAGCGCAGGACGGAGCAACCAGAACGAACAGAGCGCAAC GAGCCAGCAGGTGAACCAGAACGTCGTCAC |
| 6T | CGTCGTGTTGGTGACGACGTTCTGGTTCACCTGCTGGCTCGTTGCGCTCTGTTCGTTCTGGTT GCTCCGTCCTGCGCTTACCAGGTTTGT |
| 7B | GGTTCCAAGCACGTTCGCAACCCAGACGACGACGCGGACCGGAAGCGTGCGGCGGCGGAC GAGCCTGGGTAGCAGCACCCAGCTGGTACA |
| 7T | GGTCCGCCGCTGTACCAGCTGGGTGCTGCTACCCAGGCTCGTCCGCCGCCGCACGCTTCCGG TCCGCGTCGTCGTCTGGGTTGCGAACGT |
| 8B | GCAGCGGCAGGGAACGGGAAGCGGAACCACCACGACGACGAGCACCCGGAGCCGGCAGAC CCAGCGGAACACCAGCTTCACGAACGGAGT |
| 8T | GCTTGGAACCACTCCGTTCGTGAAGCTGGTGTTCCGCTGGGTCTGCCGGCTCCGGGTGCTCG TCGTCGTGGTGGTTCCGCTTCCCGTTCC |
| 9B | GACCACGGGTACGACCCGGGTGAGCCCAGGAACCCTGACCAACCGGGGTACGTTCCGGTTC CGGAGCAGCACCACGACGCGGACGTTTCG |
| 9T | CTGCCGCTGCCGAAACGTCCGCGTCGTGGTGCTGCTCCGGAACCGGAACGTACCCCGGTTGG TCAGGGTTCCTGGGCTCACCCGGGTCGT |
| 10B | AGTGACGGGTGCCGGACAGAGCACCTTCCAGGGAGGTAGCTTCTTCAGCCGGACGAGCCGG GGAAACAACGCAGAAACCACGGTCGGACG |
| 10T | ACCCGTGGTCCGTCCGACCGTGGTTTCTGCGTTGTTTCCCCGGCTCGTCCGGCTGAAGAAGC TACCTCCCTGGAAGGTGCTCTGTCCGGC |
| 11B | AAACCGGCGGGCACGGGGTGTCCCACGGACGCGGCGGACGGGAGGTGGACGGCGGACCAG CGTGGTGCTGACGACCAACGGACGGGTGGG |
| 11T | ACCCGTCACTCCCACCCGTCCGTTGGTCGTCAGCACCACGCTGGTCCGCCGTCCACCTCCCG TCCGCCGCGTCCGTGGGACACCCCGTGC |
| 12B | TCAGGGACGGACGCAGGGAGGACAGCAGGAAGGACGGACGCAGCTGTTCTTTGTCACCGG AGGAGTACAGGAAGTGTTTGGTTTCAGCGT |
| 12T | CCGCCGGTTTACGCTGAAACCAAACACTTCCTGTACTCCTCCGGTGACAAAGAACAGCTGCG TCCGTCCTTCCTGCTGTCCTCCCTGCGT |
| 13B | GCTGCGGCAGACGCGGCAGACGACGCGGGGTGCCCGGCATCCACGGACGGGAACCCAGGA AGATAGTTTCAACCAGACGACGAGCACCGG |

TABLE 10-continued

SYNTHESIS OF hTRT POLYNUCLEOTIDE HAVING ALTERNATIVE CODON DISTRIBUTION

| | |
|---|---|
| 13T | CCGTCCCTGACCGGTGCTCGTCGTCTGGTTGAAACTATCTTCCTGGGTTCCCGTCCGTGGA TGCCGGGCACCCCGCGTCGTCTGCCGCGT |
| 14B | GCGGGCAGTGGGTTTTCAGCAGAACACCATACGGGCACTGAGCGTGGTTGCCCAGCAGTTC CAGGAACAGCGGACGCATCTGCCAGTAAC |
| 14T | CTGCCGCAGCGTTACTGGCAGATGCGTCCGCTGTTCCTGGAACTGCTGGGCAACCACGCTCA GTGCCCGTATGGTGTTCTGCTGAAAACC |
| 15B | GGTCGGTATCTTCTTCTTCCGGAGCAGCAACGGAACCCTGCGGTTTTTCACGAGCGCAAACA CCAGCAGCCGGGGTAACAGCAGCACGCA |
| 15T | CACTGCCCGCTGCGTGCTGCTGTTACCCCGGCTGCTGGTGTTTGCGCTCGTGAAAAACCGCA GGGTTCCGTTGCTGCTCCGGAAGAAGAA |
| 16B | GCGGAACCAGACGACGCAGGCATGCACGAACGAAACCGTAAACCTGCCACGGGGAGGAGT GCTGACGCAGCAGCTGAACCAGACGACGCG |
| 16T | GATACCGACCCGCGTCGTCTGGTTCAGCTGCTGCGTCAGCACTCCTCCCCGTGGCAGGTTTA CGGTTTCGTTCGTGCATGCCTGCGTCGT |
| 17B | GGGACAGTTTAGCGTGTTTACCCAGGGAGATGAATTTTTTGGTGTTACGCAGGAAACGACGT TCGTTGTGACGGGAACCCCACAGACCCG |
| 17T | CTGGTTCCGCCGGGTCTGTGGGGTTCCCGTCACAACGAACGTCGTTTCCTGCGTAACACCAA AAAATTCATCTCCCTGGGTAAACACGCT |
| 18B | GGTGTTCAGCAGCCGGAACGCAACCAACACCCGGAGAACGACGCAGCCAAGCGCAGTCAC AACGGACATTTTCCAGGTCAGTTCCTGCA |
| 18T | AAACTGTCCCTGCAGGAACTGACCTGGAAAATGTCCGTTCGTGACTGCGCTTGGCTGCGTCG TTCTCCGGGTGTTGGTTGCGTTCCGGCT |
| 19B | CGGTAACGTAGAAGAAGGAACGCAGCAGTTCAACAACGTATACGGACATCAGCCAGTGCA GGAATTTAGCCAGGATTTCTTCACGCAGAC |
| 19T | GCTGAACACCGTCTGCGTGAAGAAATCCTGGCTAAATTCTTGCACTGGCTGATGTCCGTATA CGTTGTTGAACTGCTGCGTTCCTTCTTC |
| 20B | GTTTCAGGTGCTGACGGATACCGATGGACTGCAGTTTGGACCAAACGGATTTACGGTAGAA GAACAGACGGTTTTTCTGGAAGGTGGTTT |
| 20T | TACGTTACCGAAACCACCTTCCAGAAAAACCGTCTGTTCTTCTACCGTAAATCCGTTTGGTC CAAACTGCAGTCCATCGGTATCCGTCAG |
| 21B | GATGAAACGCAGACGGGAGGTCAGCAGAGCCGGACGAGCTTCACGGTGCTGACGAACTTCA GCTTCGGACAGTTCACGCAGCTGAACAC |
| 21T | CACCTGAAACGTGTTCAGCTGCGTGAACTGTCCGAAGCTGAAGTTCGTCAGCACCGTGAA CTCGTCCGGCTCTGCTGACCTCCCGTCTG |
| 22B | TCAGACGCTCAGCACGTTTTTCACGACGGAAGGTACGAGCACCAACAACGTAGTCCATGTTT ACGATCGGACGCAGACCGTCCGGTTTCG |
| 22T | CGTTTCATCCCGAAACCGGACGGTCTGCGTCCGATCGTAAACATGGACTACGTTGTTGGTGC TCGTACCTTCCGTCGTGAAAAACGTGCT |
| 23B | CGTCCAGACCCAGAACGGAAGCACCCAGCAGACCCGGACGACGAGCACGTTCGTAGTTCAG AACGGAGAACAGAGCTTTAACACGGGAGG |
| 23T | GAGCGTCTGACCTCCCGTGTTAAAGCTCTGTTCTCCGTTCTGAACTACGAACGTGCTCGTCG TCCGGGTCTGCTGGGTGCTTCCGTTCTG |
| 24B | CGGTAACGTCAACTTTAACGAAGTACAGTTCCGGCGGCGGGTCCTGAGCACGAACACGCAG AACGAAGGTACGCCAAGCACGGTGGATGT |
| 24T | GGTCTGGACGACATCCACCGTGCTTGGCGTACCTTCGTTCTGCGTGTTCGTGCTCAGGACCC GCCGCCGGAACTGTACTTCGTTAAAGTT |
| 25B | CGTAACGACGAACGCAGTAGGTGTTCTGCGGTTTGATGATGGAAGCGATAACTTCGGTCAG ACGGTCCTGCGGGATGGTGTCGTACGCGC |
| 25T | GACGTTACCGGCGCGTACGACACCATCCCGCAGGACCGTCTGACCGAAGTTATCGCTTCCAT CATCAAACCGCAGAACACCTACTGCGTT |
| 26B | GACGCATGTACGGCTGCAGGTCGGTCAGGGTGGAAACGTGGGATTTGAATGCTTTACGAAC GTGACCGTGAGCAGCTTTCTGAACAACAG |

TABLE 10-continued

SYNTHESIS OF hTRT POLYNUCLEOTIDE HAVING ALTERNATIVE CODON DISTRIBUTION

26T CGTCGTTACGCTGTTGTTCAGAAAGCTGCTCACGGTCACGTTCGTAAAGCATTCAAATCCCA
CGTTTCCACCCTGACCGACCTGCAGCCG

27B GACCGGAGGAAGCTTCGTTCAGGGAGGAGGACTGTTCGATAACAACAGCGTCACGCAGCGG
GGAGGTTTCCTGCAGGTGAGCAACGAACT

27T TACATGCGTCAGTTCGTTGCTCACCTGCAGGAAACCTCCCCGCTGCGTGACGCTGTTGTTAT
CGAACAGTCCTCCTCCCTGAACGAAGCT

28B AACCCTGCGGGATACCCTGGCACTGAACGTAGGATTTACCACGGATACGAACAGCGTGGTG
GCACATGAAACGCAGGAAAACGTCGAACA

28T TCCTCCGGTCTGTTCGACGTTTTCCTGCGTTTCATGTGCCACCACGCTGTTCGTATCCGTGGT
AAATCCTACGTTCAGTGCCAGGGTATC

29B GCAGCAGCAGACCGTCACGACGGATACCAGCGAACAGTTTGTTTTCCATGTCACCGTAGCA
CAGGGAGCACAGCAGGGTGGACAGGATGG

29T CCGCAGGGTTCCATCCTGTCCACCCTGCTGTGCTCCCTGTGCTACGGTGACATGGAAAACAA
ACTGTTCGCTGGTATCCGTCGTGACGGT

30B CGTATTCCGGAACACCACGAACCAGGGTACGCAGGAAGGTTTTAGCGTGGGTCAGGTGCGG
AGTAACCAGCAGGAAGTCGTCAACCAGAC

30T CTGCTGCTGCGTCTGGTTGACGACTTCCTGCTGGTTACTCCGCACCTGACCCACGCTAAAAC
CTTCCTGCGTACCCTGGTTCGTGGTGTT

31B GAGCCGGCATCTGAACGAAAGCGGTGCCACCCAGAGCTTCGTCTTCAACCGGGAAGTTAAC
AACGGTTTTACGCAGGTTTACAACGCAAC

31T CCGGAATACGGTTGCGTTGTAAACCTGCGTAAAACCGTTGTTAACTTCCCGGTTGAAGACGA
AGCTCTGGGTGGCACCGCTTTCGTTCAG

32B GGATGGAGGTACGAGCGTAGGAGGAGTAGTCGGACTGAACTTCCAGGGTACGGGTGTCCAG
CAGCAGACCGCACCACGGGAACAGACCGT

32T ATGCCGGCTCACGGTCTGTTCCCGTGGTGCGGTCTGCTGCTGGACACCCGTACCCTGGAAGT
TCAGTCCGACTACTCCTCCTACGCTCGT

33B GGGAGTGGCATTTCAGACGCAGAACACCGAACAGTTTACGACGCATGTTACGACCAGCTTT
GAAACCACGGTTGAAGGTCAGGGAAGCAC

33T ACCTCCATCCGTGCTTCCCTGACCTTCAACCGTGGTTTCAAAGCTGGTCGTAACATGCGTCGT
AAACTGTTCGGTGTTCTGCGTCTGAAA

34B ACGCGTGGAAACGGTAAGCCTGCAGCAGCAGGATTTTGTAGATGTTGGTGCAAACGGTCTG
CAGGGAGTTTACCTGCAGGTCCAGGAACA

34T TGCCACTCCCTGTTCCTGGACCTGCAGGTAAACTCCCTGCAGACCGTTTGCACCAACATCTA
CAAAATCCTGCTGCTGCAGGCTTACCGT

35B AGTAGCACAGGGAAGCGGTGTCGGAGATAACACGCAGGAAGAAGGTCGGGTTTTTCCAAA
CCTGCTGGTGGAACGGCAGCTGCAGAACGC

35T TTCCACGCGTGCGTTCTGCAGCTGCCGTTCCACCAGCAGGTTTGGAAAAACCCGACCTTCTT
CCTGCGTGTTATCTCCGACACCGCTTCC

36B GGCACAGCCACTGAACAGCTTCGGACGGCAGCGGACCAGCAGCACCTTTAGCACCCAGGGA
CATACCAGCGTTTTTAGCTTTCAGGATGG

36T CTGTGCTACTCCATCCTGAAAGCTAAAAACGCTGGTATGTCCCTGGGTGCTAAAGGTGCTGC
TGGTCCGCTGCCGTCCGAAGCTGTTCAG

37B ACAGCTGGGTCTGAGCGGTACGCAGGGAACCCAGCAGCGGAACGTAGGTAACACGGTGAC
GGGTCAGTTTCAGCAGGAAAGCCTGGT

37T TGGCTGTGCCACCAGGCTTTCCTGCTGAAACTGACCCGTCACCGTGTTACCTACGTTCCGCT
GCTGGGTTCCCTGCGTACCGCTCAG

38B ACGGCAGAGCCGGGTTAGCAGCAGCTTCCAGAGCGGTCAGGGTGGTACCCGGCAGTTTACG
GG

38T ACCCAGCTGTCCCGTAAACTGCCGGGTACCACCCTGACCGCTCTGGAAGCTGCTGCTAACCC
GG

TABLE 10-continued

SYNTHESIS OF hTRT POLYNUCLEOTIDE HAVING ALTERNATIVE CODON DISTRIBUTION

39B  GCGTGCCTCGAGGAATTCGGATCCATTAGTCCAGGATGGTTTTGAAGTCG

39T  CTCTGCCGTCCGACTTCAAAACCATCCTGGACTAATGGATCCGAATTCCTCGAGGCACGC

Table 10B (SEQ ID NO:721)

GCACGCGGGAGCTCTAGAGTCGACCATATGCCGCGTGCTCCGCGTTGCCGTGCTGTTCGTT
CCCTGCTGCGTTCCCACTATCGCGAAGTTCTGCCGCTGGCTACCTTCGTTCGTCGTCTGGG
CCCGCAGGGTTGGCGTCTGGTTCAGCGTGGTGACCCGGCTGCTTTCCGTGCTCTGGTTGCT
CAGTGCCTGGTTTGCGTTCCGTGGGACGCTCGTCCGCCGCCGGCTGCTCCGTCCTTCCGTC
AGGTTTCCTGCCTGAAAGAACTGGTTGCTCGTGTTCTGCAGCGTCTGTGCGAACGTGGTGC
TAAAAACGTTCTGGCTTTCGGTTTCGCTCTGCTGGACGGTGCTCGTGGTGGTCCGCCGGAA
GCATTCACCACCTCCGTTCGTTCCTACCTGCCGAACACCGTTACCGACGCTCTGCGTGGTT
CCGGTGCTTGGGGTCTGCTGCTGCGTCGTGTTGGTGACGACGTTCTGGTTCACCTGCTGGC
TCGTTGCGCTCTGTTCGTTCTGGTTGCTCCGTCCTGCGCTTACCAGGTTTGTGGTCCGCCG
CTGTACCAGCTGGGTGCTGCTACCCAGGCTCGTCCGCCGCCGCACGCTTCCGGTCCGCGTC
GTCGTCTGGGTTGCGAACGTGCTTGGAACCACTCCGTTCGTGAAGCTGGTGTTCCGCTGGG
TCTGCCGGCTCCGGGTGCTCGTCGTCGTGGTGGTTCCGCTTCCCGTTCCCTGCCGCTGCCG
AAACGTCCGCGTCGTGGTGCTGCTCCGGAACCGGAACGTACCCCGGTTGGTCAGGGTTCCT
GGGCTCACCCGGGTCGTACCCGTGGTCCGTCCGACCGTGGTTTCTGCGTTGTTTCCCCGGC
TCGTCCGGCTGAAGAAGCTACCTCCCTGGAAGGTGCTCTGTCCGGCACCCGTCACTCCCAC
CCGTCCGTTGGTCGTCAGCACCACGCTGGTCCGCCGTCCACCTCCCGTCCGCCGCGTCCGT
GGGACACCCCGTGCCCGCCGGTTTACGCTGAAACCAAACACTTCCTGTACTCCTCCGGTGA
CAAAGAACAGCTGCGTCCGTCCTTCCTGCTGTCCTCCCTGCGTCCGTCCCTGACCGGTGCT
CGTCGTCTGGTTGAAACTATCTTCCTGGGTTCCCGTCCGTGGATGCCGGGCACCCCGCGTC
GTCTGCCGCGTCTGCCGCAGCGTTACTGGCAGATGCGTCCGCTGTTCCTGGAACTGCTGGG
CAACCACGCTCAGTGCCCGTATGGTGTTCTGCTGAAAACCCACTGCCCGCTGCGTGCTGCT
GTTACCCCGGCTGCTGGTGTTTGCGCTCGTGAAAAACCGCAGGGTTCCGTTGCTGCTCCGG
AAGAAGAAGATACCGACCCGCGTCGTCTGGTTCAGCTGCTGCGTCAGCACTCCTCCCCGTG
GCAGGTTTACGGTTTCGTTCGTGCATGCCTGCGTCGTCTGGTTCCGCCGGGTCTGTGGGGT
TCCCGTCACAACGAACGTCGTTTCCTGCGTAACACCAAAAAATTCATCTCCCTGGGTAAAC
ACGCTAAACTGTCCCTGCAGGAACTGACCTGGAAAATGTCCGTTCGTGACTGCGCTTGGCT
GCGTCGTTCTCCGGGTGTTGGTTGCGTTCCGGCTGCTGAACACCGTCTGCGTGAAGAAATC
CTGGCTAAATTCCTGCACTGGCTGATGTCCGTATACGTTGTTGAACTGCTGCGTTCCTTCT
TCTACGTTACCGAAACCACCTTCCAGAAAAACCGTCTGTTCTTCTACCGTAAATCCGTTTG
GTCCAAACTGCAGTCCATCGGTATCCGTCAGCACCTGAAACGTGTTCAGCTGCGTGAACTG
TCCGAAGCTGAAGTTCGTCAGCACCGTGAAGCTCGTCCGGCTCTGCTGACCTCCCGTCTGC
GTTTCATCCCGAAACCGGACGGTCTGCGTCCGATCGTAAACATGGACTACGTTGTTGGTGC
TCGTACCTTCCGTCGTGAAAAACGTGCTGAGCGTCTGACCTCCCGTGTTAAAGCTCTGTTC
TCCGTTCTGAACTACGAACGTGCTCGTCGTCCGGGTCTGCTGGGTGCTTCCGTTCTGGGTC
TGGACGACATCCACCGTGCTTGGCGTACCTTCGTTCTGCGTGTTCGTGCTCAGGACCCGCC

TABLE 10-continued

SYNTHESIS OF hTRT POLYNUCLEOTIDE HAVING ALTERNATIVE CODON DISTRIBUTION

GCCGGAACTGTACTTCGTTAAAGTTGACGTTACCGGCGCGTACGACACCATCCCGCAGGAC

CGTCTGACCGAAGTTATCGCTTCCATCATCAAACCGCAGAACACCTACTGCGTTCGTCGTT

ACGCTGTTGTTCAGAAAGCTGCTCACGGTCACGTTCGTAAAGCATTCAAATCCCACGTTTC

CACCCTGACCGACCTGCAGCCGTACATGCGTCAGTTCGTTGCTCACCTGCAGGAAACCTCC

CCGCTGCGTGACGCTGTTGTTATCGAACAGTCCTCCTCCCTGAACGAAGCTTCCTCCGGTC

TGTTCGACGTTTTCCTGCGTTTCATGTGCCACCACGCTGTTCGTATCCGTGGTAAATCCTA

CGTTCAGTGCCAGGGTATCCCGCAGGGTTCCATCCTGTCCACCCTGCTGTGCTCCCTGTGC

TACGGTGACATGGAAAACAAACTGTTCGCTGGTATCCGTCGTGACGGTCTGCTGCTGCGTC

TGGTTGACGACTTCCTGCTGGTTACTCCGCACCTGACCCACGCTAAAACCTTCCTGCGTAC

CCTGGTTCGTGGTGTTCCGGAATACGGTTGCGTTGTAAACCTGCGTAAAACCGTTGTTAAC

TTCCCGGTTGAAGACGAAGCTCTGGGTGGCACCGCTTTCGTTCAGATGCCGGCTCACGGTC

TGTTCCCGTGGTGCGGTCTGCTGCTGGACACCCGTACCCTGGAAGTTCAGTCCGACTACTC

CTCCTACGCTCGTACCTCCATCCGTGCTTCCCTGACCTTCAACCGTGGTTTCAAAGCTGGT

CGTAACATGCGTCGTAAACTGTTCGGTGTTCTGCGTCTGAAATGCCACTCCCTGTTCCTGG

ACCTGCAGGTAAACTCCCTGCAGACCGTTTGCACCAACATCTACAAAATCCTGCTGCTGCA

GGCTTACCGTTTCCACGCGTGCGTTCTGCAGCTGCCGTTCCACCAGCAGGTTTGGAAAAAC

CCGACCTTCTTCCTGCGTLTTATCTCCGACACCGCTTCCCTGTGCTACTCCATCCTGAAAG

CTAAAAACGCTGGTATGTCCCTGGGTGCTAAAGGTGCTGCTGGTCCGCTGCCGTCCGAAGC

TGTTCAGTGGCTGTGCCACCAGGCTTTCCTGCTGAAACTGACCCGTCACCGTGTTACCTAC

GTTCCGCTGCTGGGTTCCCTGCGTACCGCTCAGACCCAGCTGTCCCGTAAACTGCCGGGTA

CCACCCTGACCGCTCTGGAAGCTGCTGCTAACCCGGCTCTGCCGTCCGACTTCAAAACCAT

CCTGGACTAATGGATCCGAATTCCTCGAGGCACGC

The present invention also provides transgenic animals (i.e., mammals transgenic for a human or other TRT gene sequence) expressing an hTRT or other TRT polynucleotide or polypeptide. In one embodiment, hTRT is secreted into the milk of a transgenic mammal such as a transgenic bovine, goat, or rabbit. Methods for production of such animals are found, e.g., in Heyneker et al., PCT WO 91/08216.

The hTRT proteins and complexes of the invention, including those made using the expression systems disclosed herein supra, may be purified using a variety of general methods known in the art in accordance with the specific methods provided by the present invention (e.g., infra). One of skill in the art will recognize that after chemical synthesis, biological expression, or purification, the hTRT protein may possess a conformation different than a native conformation of naturally occurring telomerase. In some instances, it may be helpful or even necessary to denature (e.g., including reduction of disulfide or other linkages) the polypeptide and then to cause the polypeptide to re-fold into the preferred conformation. Productive refolding may also require the presence of hTR (or hTR fragments). Methods of reducing and denaturing proteins and inducing re-folding are well known to those of skill in the art (see, e.g., Debinski et al., 1993, *J. Biol. Chem.*, 268:14065; Kreitman and Pastan, 1993, *Bioconjug. Chem.*, 4:581; and Buchner et al., 1992, *Anal. Biochem.*, 205:263; and McCaman et al., 1985, *J. Biotech.* 2:177). See also PCT Publication WO 96/40868, supra.

D) Complexes of Human TRT and Human Telomerase RNA, Telomerase-Associated Proteins, and Other Biomolecules Produced by Coexpression and Other Means hTRT polypeptides of the invention can associate in vivo and in vitro with other biomolecules, including RNAs (e.g., hTR), proteins (e.g., telomerase-associated proteins), DNA (e.g., telomeric DNA, $[T_2AG_3]_N$), and nucleotides, such as (deoxy)ribonucleotide triphosphates. These associations can be exploited to assay hTRT presence or function, to identify or purify hTRT or telomerase-associated molecules, and to analyze hTRT or telomerase structure or function in accordance with the methods of the present invention.

In one embodiment, the present invention provides hTRT complexed with (e.g., associated with or bound to) a nucleic acid, usually an RNA, for example to produce a telomerase holoenzyme. In one embodiment, the bound RNA is capable of acting as a template for telomerase-mediated DNA synthesis. Examples of RNAs that may be complexed with the hTRT polypeptide include a naturally occurring host cell telomerase RNA, a human telomerase RNA (e.g., hTR; U.S. Pat. No. 5,583,016), an hTR subsequence or domain, a synthetic RNA, or other RNAs. The RNA-hTRT protein complex (an RNP) typically exhibits one or more telomerase activities, such as telomerase catalytic activities. These hTRT-hTR RNPs (or other hTRT-RNA complexes) can be produced by a variety of methods, as described infra for illustrative purposes, including in vitro reconstitution, by co-expression of hTRT and hTR (or other RNA) in vitro (i.e., in a cell free system), in vivo reconstitution, or ex vivo reconstitution.

Thus, the present invention provides, in one embodiment, an hTRT-hTR complex (or other hTRT-RNA complex) formed in vitro by mixing separately purified components ("in vitro reconstitution;" see, e.g., U.S. Pat. No. 5,583,016 for a description of reconstitution; also see Autexier et al., EMBO J. 15:5928). In one embodiment the hTRT protein is produced by recombinant expression in human or non-human cells, e.g., as described supra, and subsequently purified using protein purification methods (e.g., chromatography, affinity purification). In a particular embodiment, the recombinant hTRT protein is purified to homogeneity. The purified hTRT protein is combined with separately purified hTR, which may be produced using an in vitro transcription system, by chemical synthesis, or by other methods and purified using standard RNA purification techniques (see Melton et al., 1984, Nucl. Acids Res. 12:7035; Studier et al., 1986, J. Mol. Biol. 189:113).

In an alternative embodiment, the invention provides telomerase RNPs produced by coexpression of the hTRT polypeptide and an RNA (e.g., hTR) in vitro in a cell-free transcription-translation system (e.g. wheat germ or rabbit reticulocyte lysate) As shown in Example 7, in vitro co-expression of a recombinant hTRT polypeptide and hTR results in production of telomerase catalytic activity (as measured by a TRAP assay).

Further provided by the present invention are telomerase RNPs produced by expression of the hTRT polypeptide in a cell, e.g., a mammalian cell, in which hTR is naturally expressed or in which hTR (or another RNA capable of forming a complex with the hTRT protein) is introduced or expressed by recombinant means. Thus, in one embodiment, hTRT is expressed in a telomerase negative human cell in which hTR is present (e.g., BJ or IMP90 cells), allowing the two molecules to assemble into an RNP. In another embodiment, hTRT is expressed in a human or non-human cell in which hTR is recombinantly expressed. Methods for expression of hTR in a cell are found in U.S. Pat. No. 5,583,016. Further, a clone containing a cDNA encoding the RNA component of telomerase has been placed on deposit as pGRN33 (ATCC 75926). Genomic sequences encoding the RNA component of human telomerase are also on deposit in the ~15 kb SauIIIA1 to HindIII insert of lambda clone 28-1 (ATCC 75925). For expression in eukaryotic cells the hTRT sequence will typically be operably linked to a transcription initiation sequence (RNA polymerase binding site) and transcription terminator sequences (see, e.g., PCT Publication WO 96/01835; Feng et al., 1995, Science 269:1236).

The present invention further provides recombinantly produced or substantially purified hTRT polypeptides coexpressed and/or associated with so-called "telomerase-associated proteins." Thus, the present invention provides hTRT coexpressed with, or complexed with, other proteins (e.g., telomerase-associated proteins). Telomerase-associated proteins are those proteins that copurify with human telomerase and/or may play a role in modulating telomerase function or activity, for example by participating in the association of telomerase with telomeric DNA. Examples of telomerase-associated proteins include (but are not limited to) the following proteins and/or their human homologs: nucleolin (see, Srivastava et al., 1989, FEBS Letts. 250:99); EF2H (elongation factor 2 homolog; see Nomura et al. 1994, DNA Res. (Japan) 1:27, GENBANK accession #D21163); TP1/TLP1 (Harrington et al., 1997, Science 275:973; Nakayama, 1997, Cell 88:875); the human homologue of the Tetrahymena p95 or p95 itself (Collins et al., 1995, Cell 81:677); TPC2 (a telomere length regulatory protein; ATCC accession number 97708; TPC3 (also a telomere length regulatory protein; ATCC accession number 97707; DNA-binding protein B (dbpB; Horwitz et al., 1994, J. Biol. Chem. 269: 14130; and Telomere Repeat Binding Factors (TRF 1 & 2; Chang et al., 1995, Science 270:1663; Chong et al., 1997, Hum Mol Genet 6:69); EST1, 3 and 4 (Lendvay et al., 1996, Genetics 144:1399, Nugent et al., 1996, Science 274:249, Lundblad et al., 1989, Cell 57:633); and End-capping factor (Cardenas et al., 1993, Genes Dev. 7:883).

Telomerase associated proteins can be identified on the basis of co-purification with, or binding to, hTRT protein or the hTRT-hTR RNP. Alternatively, they can be identified on the basis of binding to an hTRT fusion protein, e.g., a GST-hTRT fusion protein or the like, as determined by affinity purification (see, Ausubel et al. Ch 20). A particularly useful technique for assessing protein-protein interactions, which is applicable to identifying hTRT-associated proteins, is the two hybrid screen method of Chien et al. (Proc. Natl. Acad. Sci. USA 88:9578 [1991]; see also Ausubel et al., supra, at Ch. 20). This screen identifies protein-protein interactions in vivo through reconstitution of a transcriptional activator, the yeast Gal4 transcription protein (see, Fields and Song, 1989, Nature 340:245). The method is based on the properties of the yeast Gal4 protein, which consists of separable domains responsible for DNA-binding and transcriptional activation. Polynucleotides, usually expression vectors, encoding two hybrid proteins are constructed. One polynucleotide comprises the yeast Gal4 DNA-binding domain fused to a polypeptide sequence of a protein to be tested for an hTRT interaction (e.g., nucleolin or EF2H). Alternatively the yeast Gal4 DNA-binding domain is fused to cDNAs from a human cell, thus creating a library of human proteins fused to the Gal4 DNA binding domain for screening for telomerase associated proteins. The other polynucleotide comprises the Gal4 activation domain fused to an hTRT polypeptide sequence. The constructs are introduced into a yeast host cell. Upon expression, intermolecular binding between hTRT and the test protein can reconstitute the Gal4 DNA-binding domain with the Gal4 activation domain. This leads to the transcriptional activation of a reporter gene (e.g., lacZ, HIS3) operably linked to a Gal4 binding site. By selecting for, or by assaying the reporter, gene colonies of cells that contain an hTRT interacting protein or telomerase associated protein can be identified. Those of skill will appreciate that there are numerous variations of the 2-hybrid screen, e.g., the LexA system (Bartel et al, 1993, in Cellular Interactions in Development: A Practical Approach Ed. Hartley, D. A. (Oxford Univ. Press) pp. 153-79).

Another useful method for identifying telomerase-associated proteins is a three-hybrid system (see, e.g., Zhang et al., 1996, Anal. Biochem. 24:68; Licitra et al., 1996, Proc. Natl. Acad. Sci. USA 93:12817). The telomerase RNA component can be utilized in this system with the TRT or hTRT protein and a test protein. Another useful method for identifying interacting proteins, particularly (i.e., proteins that heterodimerize or form higher order heteromultimers), is the E. coliBCCP interactive screening system (see, Germino et al. (1993) *Proc. Natl. Acad. Sci. U.S.A.* 90:933; Guarente (1993) *Proc. Natl. Acad. Sci.* (U.S.A.) 90:1639).

The present invention also provides complexes of telomere binding proteins (which may or may not be telomerase associated proteins) and hTRT (which may or may not be complexed with hTR, other RNAs, or one or more telomerase associated proteins). Examples of telomere binding proteins include TRF1 and TRF2 (supra); rnpA1, rnpA2, RAP1 (Buchman et al., 1988, *Mol. Cell. Biol.* 8:210, Buchman et al., 1988, *Mol. Cell. Biol.* 8:5086), SIR3 and SIR4 (Aparicio et al, 1991, *Cell* 66:1279), TEL1 (Greenwell et al., 1995, *Cell* 82:823; Morrow et al., 1995, *Cell* 82:831); ATM (Savitsky et al., 1995, Science 268:1749), end-capping factor (Cardenas et al., 1993, *Genes Dev.* 7:883), and corresponding human homologs. The aforementioned complexes may be produced generally as described supra for complexes of hTRT and hTR or telomerase associated proteins, e.g., by mixing or co-expression in vitro or in vivo.

V. ANTIBODIES AND OTHER BINDING AGENTS

In a related aspect, the present invention provides antibodies that are specifically immunoreactive with hTRT, including polyclonal and monoclonal antibodies, antibody fragments, single chain antibodies, human and chimeric antibodies, including antibodies or antibody fragments fused to phage coat or cell surface proteins, and others known in the art and described herein. The antibodies of the invention can specifically recognize and bind polypeptides that have an amino acid sequence that is substantially identical to the amino acid sequence set forth in FIG. 17 SEQ ID NO:2, or an immunogenic fragment thereof or epitope on the protein defined thereby. The antibodies of the invention can exhibit a specific binding affinity for hTRT of at least about $10^7$, $10^8$, $10^9$, or $10^{10}$ M$^{-1}$, and may be polyclonal, monoclonal, recombinant or otherwise produced. The invention also provides anti-hTRT antibodies that recognize an hTRT conformational epitope (e.g., an epitope on the surface of the hTRT protein or a telomerase RNP). Likely conformational epitopes can be identified, if desired, by computer-assisted analysis of the hTRT protein sequence, comparison to the conformation of related reverse transcriptases, such as the p66 subunit of HIV-1 (see, e.g., FIG. 3), or empirically. Anti-hTRT antibodies that recognize conformational epitopes have utility, inter alia, in detection and purification of human telomerase and in the diagnosis and treatment of human disease.

For the production of anti-hTRT antibodies, hosts such as goats, sheep, cows, guinea pigs, rabbits, rats, or mice, may be immunized by injection with hTRT protein or any portion, fragment or oligopeptide thereof which retains immunogenic properties. In selecting hTRT polypeptides for antibody induction, one need not retain biological activity; however, the protein fragment, or oligopeptide must be immunogenic, and preferably antigenic. Immunogenicity can be determined by injecting a polypeptide and adjuvant into an animal (e.g., a rabbit) and assaying for the appearance of antibodies directed against the injected polypeptide (see, e.g., Harlow and Lane, ANTIBODIES: A LABORATORY MANUAL, COLD SPRING HARBOR LABORATORY, New York (1988), which is incorporated in its entirety and for all purposes, e.g., at Chapter 5). Peptides used to induce specific antibodies typically have an amino acid sequence consisting of at least five amino acids, preferably at least 8 amino acids, more preferably at least 10 amino acids. Usually they will mimic or have substantial sequence identity to all or a contiguous portion of the amino acid sequence of the protein of SEQ ID NO:2. Short stretches of hTRT protein amino acids may be fused with those of another protein, such as keyhole limpet hemocyanin, and an anti-hTRT antibody produced against the chimeric molecule. Depending on the host species, various adjuvants may be used to increase immunological response.

The antigen is presented to the immune system in a fashion determined by methods appropriate for the animal. These and other parameters are generally well known to immunologists. Typically, injections are given in the footpads, intramuscularly, intradermally, perilymph nodally or intraperitoneally. The immunoglobulins produced by the host can be precipitated, isolated and purified by routine methods, including affinity purification.

Illustrative examples of immunogenic hTRT peptides include are provided in Example 8. In addition, Example 8 describes the production and use of anti-hTRT polyclonal antibodies.

A) Monoclonal Antibodies

Monoclonal antibodies to hTRT proteins and peptides may be prepared in accordance with the methods of the invention using any technique which provides for the production of antibody molecules by continuous cell lines in culture. These include, but are not limited to, the hybridoma technique originally described by Koehler and Milstein (*Nature* 256:495 [1975]), the human B-cell hybridoma technique (Kosbor et al., 1983, *Immunol. Today* 4:72; Cote et al., 1983, *Proc. Natl. Acad. Sci. USA,* 80:2026), and the EBV-hybridoma technique (Cole et al., MONOCLONAL ANTIBODIES AND CANCER THERAPY, Alan R Liss Inc, New York N.Y., pp 77-96 [1985]).

In one embodiment, appropriate animals are selected and the appropriate immunization protocol followed. The production of non-human monoclonal antibodies, e.g., murine, lagomorpha, equine, is well known and can be accomplished by, for example, immunizing an animal with a preparation containing hTRT or fragments thereof. In one method, after the appropriate period of time, the spleens of the animals are excised and individual spleen cells are fused, typically, to immortalized myeloma cells under appropriate selection conditions. Thereafter, the cells are clonally separated and the supernatants of each clone (e.g., hybridoma) are tested for the production of an appropriate antibody specific for the desired region of the antigen. Techniques for producing antibodies are well known in the art. See, e.g., Goding et al., MONOCLONAL ANTIBODIES: PRINCIPLES AND PRACTICE (2ED.) Acad. Press, N.Y., and Harlow and Lane, supra, each of which is incorporated in its entirety and for all purposes. Other suitable techniques involve the in vitro exposure of lymphocytes to the antigenic polypeptides or alternatively, to selection of libraries of antibodies in phage or similar vectors (see, infra).

B) Human Antibodies

In another aspect of the invention, human antibodies against an hTRT polypeptide are provided. Human monoclonal antibodies against a known antigen can also be made using transgenic animals having elements of a human immune system (see, e.g., U.S. Pat. Nos. 5,569,825 and 5,545,806, both of which are incorporated by reference in their entirety for all purposes) or using human peripheral blood cells (Casali et al., 1986, *Science* 234:476). Some human antibodies are selected by competitive binding experiments, or otherwise, to have the same epitope specificity as a particular mouse antibody.

In an alternative embodiment, human antibodies to an hTRT polypeptide can be produced by screening a DNA library from human B cells according to the general protocol outlined by Huse et al., 1989, *Science* 246:1275, which is incorporated by reference. Antibodies binding to the hTRT polypeptide are selected. Sequences encoding such antibodies (or binding fragments) are then cloned and amplified. The protocol described by Huse is often used with phage-display technology.

C) Humanized or Chimeric Antibodies

The invention also provides anti-hTRT antibodies that are made chimeric, human-like or humanized, to reduce their potential antigenicity, without reducing their affinity for their target. Preparation of chimeric, human-like and humanized antibodies have been described in the art (see, e.g., U.S. Pat. Nos. 5,585,089 and 5,530,101; Queen, et al., 1989, *Proc. Nat'l Acad. Sci. USA* 86:10029; and Verhoeyan et al., 1988, *Science* 239:1534; each of which is incorporated by reference in their entirety and for all purposes). Humanized immunoglobulins have variable framework regions substantially from a human immunoglobulin (termed an acceptor immunoglobulin) and complementarity determining regions substantially from a non-human (e.g., mouse) immunoglobulin (referred to as the donor immunoglobulin). The constant region(s), if present, are also substantially from a human immunoglobulin.

In some applications, such as administration to human patients, the humanized (as well as human) anti-hTRT antibodies of the present invention offer several advantages over antibodies from murine or other species: (1) the human immune system should not recognize the framework or constant region of the humanized antibody as foreign, and therefore the antibody response against such an injected antibody should be less than against a totally foreign mouse antibody or a partially foreign chimeric antibody; (2) because the effector portion of the humanized antibody is human, it may interact better with other parts of the human immune system; and (3) injected humanized antibodies have a half-life essentially equivalent to naturally occurring human antibodies, allowing smaller and less frequent doses than antibodies of other species. As implicit from the foregoing, anti hTRT antibodies have application in the treatment of disease, i.e., to target telomerase-positive cells.

D) Phage Display

The present invention also provides anti-hTRT antibodies (or binding compositions) produced by phage display methods (see, e.g., Dower et al., WO 91/17271 and McCafferty et al., WO 92/01047; and Vaughan et al, 1996, *Nature Biotechnology*, 14: 309; each of which is incorporated by reference in its entirety for all purposes). In these methods, libraries of phage are produced in which members display different antibodies on their outer surfaces. Antibodies are usually displayed as Fv or Fab fragments. Phage displaying antibodies with a desired specificity are selected by affinity enrichment to an hTRT polypeptide.

In a variation of the phage-display method, humanized antibodies having the binding specificity of a selected murine antibody can be produced. In this method, either the heavy or light chain variable region of the selected murine antibody is used as a starting material. If, for example, a light chain variable region is selected as the starting material, a phage library is constructed in which members display the same light chain variable region (i.e., the murine starting material) and a different heavy chain variable region. The heavy chain variable regions are obtained from a library of rearranged human heavy chain variable regions. A phage showing strong specific binding for the hTRT polypeptide (e.g., at least $10^8$ and preferably at least $10^9$ $M^{-1}$) is selected. The human heavy chain variable region from this phage then serves as a starting material for constructing a further phage library. In this library, each phage displays the same heavy chain variable region (i.e., the region identified from the first display library) and a different light chain variable region. The light chain variable regions are obtained from a library of rearranged human variable light chain regions. Again, phage showing strong specific binding are selected. These phage display the variable regions of completely human anti-hTRT antibodies. These antibodies usually have the same or similar epitope specificity as the murine starting material.

E) Hybrid Antibodies

The invention also provides hybrid antibodies that share the specificity of antibodies against an hTRT polypeptide but are also capable of specific binding to a second moiety. In such hybrid antibodies, one heavy and light chain pair is usually from an anti-hTRT antibody and the other pair from an antibody raised against another epitope or protein. This results in the property of multi-functional valency, i.e., ability to bind at least two different epitopes simultaneously, where at least one epitope is the epitope to which the anti-complex antibody binds. Such hybrids can be formed by fusion of hybridomas producing the respective component antibodies, or by recombinant techniques. Such hybrids can be used to carry a compound (i.e., drug) to a telomerase-positive cell (i.e., a cytotoxic agent is delivered to a cancer cell).

Immunoglobulins of the present invention can also be fused to functional regions from other genes (e.g., enzymes) to produce fusion proteins (e.g., immunotoxins) having useful properties.

F) Anti-Idiotypic Antibodies

Also useful are anti-idiotype antibodies which can be isolated by the above procedures. Anti-idiotypic antibodies may be prepared by, for example, immunization of an animal with the primary antibody (i.e., anti-hTRT antibodies or hTRT-binding fragments thereof). For anti-hTRT antibodies, anti-idiotype antibodies whose binding to the primary antibody is inhibited by an hTRT polypeptide or fragments thereof are selected. Because both the anti-idiotypic antibody and the hTRT polypeptide or fragments thereof bind the primary immunoglobulin, the anti-idiotypic immunoglobulin can represent the "internal image" of an epitope and thus can substitute for the hTRT polypeptide in assays or can be used to bind (i.e., inactivate) anti-hTRT antibodies, e.g., in a patient. Anti-idiotype antibodies can also interact with telomerase associated proteins. Administration of such antibodies can affect telomerase function by titrating out or competing with hTRT in binding to hTRT-associated proteins.

G) General

The antibodies of the invention may be of any isotype, e.g., IgM, IgD, IgG, IgA, and IgE, with IgG, IgA and IgM often preferred. Humanized antibodies may comprise sequences from more than one class or isotype.

In another embodiment of the invention, fragments of the intact antibodies described above are provided. Typically, these fragments can compete with the intact antibody from which they were derived for specific binding to the hTRT polypeptide, and bind with an affinity of at least $10^7$, $10^8$, $10^9$ $M^{-1}$, or $10^{10}$ $M^{-1}$. Antibody fragments include separate heavy chains, light chains, Fab, Fab' F(ab')$_2$, Fabc, and Fv. Fragments can be produced by enzymatic or chemical separation of intact immunoglobulins. For example, a F(ab')$_2$ fragment can be obtained from an IgG molecule by proteolytic digestion with pepsin at pH 3.0-3.5 using standard methods such as those described in Harlow and Lane, supra.

Fab fragments may be obtained from F(ab')$_2$ fragments by limited reduction, or from whole antibody by digestion with papain in the presence of reducing agents (see generally, Paul, W., ed FUNDAMENTAL IMMUNOLOGY 2ND Raven Press, N.Y., 1989, Ch. 7, incorporated by reference in its entirety for all purposes). Fragments can also be produced by recombinant DNA techniques. Segments of nucleic acids encoding selected fragments are produced by digestion of full-length coding sequences with restriction enzymes, or by de novo synthesis. Often fragments are expressed in the form of phage-coat fusion proteins.

Many of the immunoglobulins described above can undergo non-critical amino-acid substitutions, additions or deletions in both the variable and constant regions without loss of binding specificity or effector functions, or intolerable reduction of binding affinity (i.e., below about $10^7$ $M^{-1}$). Usually, immunoglobulins incorporating such alterations exhibit substantial sequence identity to a reference immunoglobulin from which they were derived. A mutated immunoglobulin can be selected having the same specificity and increased affinity compared with a reference immunoglobulin from which it was derived. Phage-display technology offers useful techniques for selecting such immunoglobulins. See, e.g., Dower et al., WO 91/17271 McCafferty et al., WO 92/01047; and Huse, WO 92/06204.

The antibodies of the present invention can be used with or without modification. Frequently, the antibodies will be labeled by joining, either covalently or non-covalently, a detectable label. As labeled binding entities, the antibodies of the invention are particularly useful in diagnostic applications.

The anti-hTRT antibodies of the invention can be purified using well known methods. The whole antibodies, their dimers, individual light and heavy chains, or other immunoglobulin forms of the present invention can be purified using the methods and reagents of the present invention in accordance with standard procedures of the art, including ammonium sulfate precipitation, affinity columns, column chromatography, gel electrophoresis and the like (see generally Scopes, PROTEIN PURIFICATION: PRINCIPLES AND PRACTICE 3RD EDITION (Springer-Verlag, N.Y., 1994)). Substantially pure immunoglobulins of at least about 90 to 95%, or even 98 to 99% or more homogeneity are preferred.

VI. PURIFICATION OF HUMAN TELOMERASE

The present invention provides isolated human telomerase of unprecedented purity. In particular, the present invention provides: purified hTRT of recombinant or non-recombinant origin; purified hTRT-hTR complexes (i.e., RNPs) of recombinant, nonrecombinant, or mixed origin, optionally comprising one or more telomerase-associated proteins; purified naturally occurring human telomerase; and the like. Moreover, the invention provides methods and reagents for partially, substantially or highly purifying the above-molecules and complexes, including variants, fusion proteins, naturally occurring proteins, and the like (collectively referred to as "hTRT and/or hTRT complexes").

Prior to the present disclosure, attempts had been made to purify the telomerase enzyme complex to homogeneity had met with limited success. The methods provided in the aforelisted applications provide purification of telomerase by approximately up to 60,000-fold or more compared to crude cell extracts. The present invention provides hTRT and hTRT complexes of even greater purity, in part by virtue of the novel immunoaffinity reagents (e.g., anti-hTRT antibodies) of the present invention, and/or the reagents, cells, and methods provided herein for recombinant expression of hTRT. Recombinant expression of hTRT and hTRT complexes facilitates purification because the desired molecules can be produced at much higher levels than found in most expressing cells occurring in nature, and/or because the recombinant hTRT molecule can be modified (e.g., by fusion with an epitope tag) such that it may be easily purified.

It will be recognized that naturally occurring telomerase can be purified from any telomerase-positive cell, and recombinant hTRT and hTRT complexes can be expressed and purified, inter alia, using any of the in vitro, in vivo, ex vivo, or plant or animal expression systems disclosed supra, or others/systems known in the art.

In one embodiment, the hTRT, telomerase and other compositions of the invention are purified using an immunoaffinity step, alone or in combination with other purification steps. Typically, an immobilized or immobilizable anti-hTRT antibody, as provided by the present invention, is contacted with a sample, such as a cell lysate, that contains the desired hTRT or hTRT-containing complex under conditions in which anti-hTRT antibody binds the hTRT antigen. After removal of the unbound components of the sample by methods well known in the art, the hTRT composition may be eluted, if desired, from the antibody, in substantially pure form. In one embodiment, immunoaffinity chromatography methods well known in the art are used (see, e.g., Harlow and Lane, supra; and Ausubel, supra; Hermansan et al., 1992, IMMOBILIZED AFFINITY LIGAND TECHNIQUES (Academic Press, San Diego)) in accordance with the methods of the invention. In another illustrative embodiment, immunoprecipitation of anti-hTRT-immunoglobulin-hTRT complexes is carried out using immobilized Protein A. Numerous variations and alternative immunoaffinity purification protocols suitable for use in accordance with the methods and reagents of the invention are well-known to those of skill.

In another embodiment, recombinant hTRT proteins can, as a consequence of their high level of expression, be purified using routine protein purification methods, such as ammonium sulfate precipitation, affinity columns (e.g., immunoaffinity), size-exclusion, anion and cation exchange chromatography, gel electrophoresis and the like (see, generally, R. Scopes, PROTEIN PURIFICATION, Springer-Verlag, N.Y. (1982) and Deutscher, METHODS IN ENZYMOLOGY VOL. 182: GUIDE TO PROTEIN PURIFICATION, Academic Press, Inc. N.Y. (1990)) instead of, or in addition to, immunoaffinity methods. Cation exchange methods can be particularly useful due to the basic pI of the hTRT protein. For example, immobilized phosphate may be used as a cation exchange functional group (e.g., P-11 Phosphocellulose, Whatman catalog #4071 or Cellulose Phosphate, Sigma catalog #C 3145). Immobilized phosphate has two advantageous features for hTRT purification—it is a cation exchange resin, and it shows physical resemblance to the phosphate backbone of nucleic acid. This can allow for affinity chromatography because hTRT binds hTR and telomeric DNA. Other non-specific and specific nucleic acid affinity chromatography methods are also useful for purification (e.g., Alberts et al., 1971, *Methods Enzymol.* 21:198; Arnt-Jovin et al., 1975, *Eur. J. Biochem.* 54:411; Pharmacia catalog #27-5575-02). Further exploitation of this binding function of hTRT could include the use of specific nucleic acid (e.g., telomerase primer or hTR) affinity chromatography for purification (Chodosh et al., 1986, *Mol. Cell. Biol.* 6:4723; Wu et al., 1987, *Science* 238:1247; Kadonaga, 1991, *Methods Enzymol.* 208:10); immobilized Cibricon Blue Dye, which shows physical resemblance to nucleotides, is another useful resin for hTRT purification (Pharmacia catalog #17-0948-01 or Sigma catalog #C 1285), due to hTRT binding of nucleotides (e.g., as substrates for DNA synthesis).

In one embodiment, hTRT proteins are isolated directly from an in vitro or in vivo expression system in which other telomerase components are not coexpressed. It will be recognized that isolated hTRT protein may also be readily obtained from purified human telomerase or hTRT complexes, for example, by disrupting the telomerase RNP (e.g., by exposure to a mild or other denaturant) and separating the RNP components (e.g., by routine means such as chromatography or immunoaffinity chromatography).

Telomerase purification may be monitored using a telomerase activity assay (e.g., the TRAP assay, conventional assay, or primer-binding assay), by measuring the enrichment of hTRT (e.g., by ELISA), by measuring the enrichment of hTR, or other methods known in the art.

The purified human telomerase, hTRT proteins, and hTRT complexes provided by the present invention are, in one embodiment, highly purified (i.e., at least about 90% homogeneous, more often at least about 95% homogeneous). Homogeneity can be determined by standard means such as SDS-polyacrylamide gel electrophoresis and other means known in the art (see, e.g., Ausubel et al, supra). It will be understood that, although highly purified human telomerase, hTRT protein, or hTRT complexes are sometimes desired, substantially purified (e.g., at least about 75% homogeneous) or partially purified (e.g., at least about 20% homogeneous) human telomerase, hTRT protein, or hTRT complexes are useful in many applications, and are also provided by the present invention. For example, partially purified telomerase is useful for screening test compounds for telomerase modulatory activity, and other uses (see, infra and supra; see U.S. Pat. No. 5,645,986).

VII. TREATMENT OF TELOMERASE-RELATED DISEASE

A) Introduction

The present invention provides hTRT polynucleotides, polypeptides, and antibodies useful for the treatment of human diseases and disease conditions. The recombinant and synthetic hTRT gene products (protein and mRNA) of the invention can be used to create or elevate telomerase activity in a cell, as well as to inhibit telomerase activity in cells in which it is not desired. Thus, inhibiting, activating or otherwise altering a telomerase activity (e.g., telomerase catalytic activity, fidelity, processivity, telomere binding, etc.) in a cell can be used to change the proliferative capacity of the cell. For example, reduction of telomerase activity in an immortal cell, such as a malignant tumor cell, can render the cell mortal. Conversely, increasing the telomerase activity in a mortal cell (e.g., most human somatic cells) can increase the proliferative capacity of the cell. For example, expression of hTRT protein in dermal fibroblasts, thereby increasing telomere length, will result in increased fibroblast proliferative capacity; such expression can slow or reverse the age-dependent slowing of wound closure (see, e.g., West, 1994, Arch. Derm. 130:87).

Thus, in one aspect, the present invention provides reagents and methods useful for treating diseases and conditions characterized by the presence, absence, or amount of human telomerase activity in a cell and that are susceptible to treatment using the compositions and methods disclosed herein. These diseases include, as described more fully below, cancers, other diseases of cell proliferation (particularly diseases of aging), immunological disorders, infertility (or fertility), and others.

B) Treatment of Cancer

The present invention provides methods and compositions for reducing telomerase activity in tumor cells and for treating cancer. Compositions include antisense oligonucleotides, peptides, gene therapy vectors encoding antisense oligonucleotides or activity altering proteins, and anti-hTRT antibodies. Cancer cells (e.g., malignant tumor cells) that express telomerase activity (telomerase-positive cells) can be mortalized by decreasing or inhibiting the endogenous telomerase activity. Moreover, because telomerase levels correlate with disease characteristics such as metastatic potential (e.g., U.S. Pat. Nos. 5,639,613; 5,648,215; 5,489,508; Pandita et al., 1996, Proc. Am. Ass. Cancer Res. 37:559), any reduction in telomerase activity could reduce the aggressive nature of a cancer to a more manageable disease state (increasing the efficacy of traditional interventions).

The invention provides compositions and methods useful for treatment of cancers of any of a wide variety of types, including solid tumors and leukemias. Types of cancer that may be treated include (but are not limited to): adenocarcinoma of the breast, prostate, and colon; all forms of bronchogenic carcinoma of the lung; myeloid; melanoma; hepatoma; neuroblastoma; papilloma; apudoma; choristoma; branchioma; malignant carcinoid syndrome; carcinoid heart disease; carcinoma (e.g., Walker, basal cell, basosquamous, Brown-Pearce, ductal, Ehrlich tumor, in situ, Krebs 2, merkel cell, mucinous, non-small cell lung, oat cell, papillary, scirrhous, bronchiolar, bronchogenic, squamous cell, and transitional cell), histiocytic disorders; leukemia (e.g., B-cell, mixed-cell, null-cell, T-cell, T-cell chronic, HTLV-II-associated, lyphocytic acute, lymphocytic chronic, mast-cell, and myeloid); histiocytosis malignant; Hodgkin's disease; immunoproliferative small; non-Hodgkin's lymphoma; plasmacytoma; reticuloendotheliosis; melanoma; chondroblastoma; chordroma; chondrosarcoma; fibroma; fibrosarcoma; giant cell tumors; histiocytoma; lipoma; liposarcoma; mesothelioma; myxoma; myxosarcoma; osteoma; osteosarcoma; Ewing's sarcoma; synovioma; adenofibroma; adenolymphoma; carcinosarcoma; chordoma; craniopharyngioma; dysgerminoma; hamartoma; mesenchymoma; mesonephroma; myosarcoma; ameloblastoma; cementoma; odontoma; teratoma; thymoma; trophoblastic tumor; adenocarcinoma; adenoma; cholangioma; cholesteatoma; cylindroma; cystadenocarcinoma; cystadenoma; granulosa cell tumor; gynandroblastoma; hepatoma; hidradenoma; islet cell tumor; leydig cell tumor; papilloma; sertoli cell tumor; theca cell tumor; leiomyoma; leiomyosarcoma; myoblastoma; myoma; myosarcoma; rhabdomyoma; rhabdomyosarcoma; ependymoma; ganglioneuroma; glioma; medulloblastoma; meningioma; neurilemmoma; neuroblastoma; neuroepithelioma; neurofibroma; neuroma; paraganglioma; paraganglioma nonchromaffin; angiokeratoma; angiolymphoid hyperplasia with eosinophilia; angioma sclerosing; angiomatosis; glomangioma; hemangioendothelioma; hemangioma; hemangiopericytoma; hemangiosarcoma; lymphangioma; lymphangiomyoma; lymphangiosarcoma; pinealoma; carcinosarcoma; chondrosarcoma; cystosarcoma phyllodes; fibrosarcoma; hemangiosarcoma; leiomyosarcoma; leukosarcoma; liposarcoma; lymphangiosarcoma; myosarcoma; myxosarcoma; ovarian carcinoma; rhabdomyosarcoma; sarcoma (e.g., Ewing's, experimental, Kaposi's, and mast-cell); neoplasms (e.g., bone, breast, digestive system, colorectal, liver, pancreatic, pituitary, testicular, orbital, head and neck, central nervous system, acoustic, pelvic, respiratory tract, and urogenital); neurofibromatosis, and cervical dysplasia). The invention provides compositions and methods useful for treatment of other conditions in which cells have become immortalized or hyperproliferative, e.g., by disregulation (e.g., abnormally high expression) of hTRT, telomerase enzyme, or telomerase activity.

The present invention further provides compositions and methods for prevention of cancers, including anti-hTRT vaccines, gene therapy vectors that prevent telomerase activation, and gene therapy vectors that result in specific death of telomerase-positive cells. In a related aspect, the gene replacement therapy methods described below may be used for "treating" a genetic predilection for cancers.

C) Treatment of Other Conditions

The present invention also provides compositions and methods useful for treatment of diseases and disease conditions (in addition to cancers) characterized by under- or over-expression of telomerase or hTRT gene products. Examples include: diseases of cell proliferation, diseases resulting from cell senescence (particularly diseases of aging), immunological disorders, infertility, diseases of immune dysfunction, and others.

Certain diseases of aging are characterized by cell senescence-associated changes due to reduced telomere length (compared to younger cells), resulting from the absence (or much lower levels) of telomerase activity in the cell. Decreased telomere length and decreased replicative capacity contribute to diseases such as those described below. Telomerase activity and telomere length can be increased by, for example, increasing levels of hTRT gene products (protein and mRNA) in the cell. A partial listing of conditions associated with cellular senescence in which hTRT expression can be therapeutic includes Alzheimer's disease, Parkinson's disease, Huntington's disease, and stroke; age-related diseases of the integument such as dermal atrophy, elastolysis and skin wrinkling, sebaceous gland hyperplasia, senile lentigo, graying of hair and hair loss, chronic skin ulcers, and age-related impairment of wound healing; degenerative joint disease; osteoporosis; age-related immune system impairment (e.g., involving cells such as B and T lymphocytes, monocytes, neutrophils, eosinophils, basophils, NK cells and their respective progenitors); age-related diseases of the vascular system including atherosclerosis, calcification, thrombosis, and aneurysms; diabetes, muscle atrophy, respiratory diseases, diseases of the liver and GI tract, metabolic diseases, endocrine diseases (e.g., disorders of the pituitary and adrenal gland), reproductive diseases, and age-related macular degeneration. These diseases and conditions can be treated by increasing the levels of hTRT gene products in the cell to increase telomere length, thereby restoring or imparting greater replicative capacity to the cell. Such methods can be carried out on cells cultured ex vivo or cells in vivo. In one embodiment, the cells are first treated to activate telomerase and lengthen telomeres, and then treated to inactivate the hTRT gene and telomerase activity. In a preferred embodiment, telomerase activity is generated by a vector of the invention in an embryonic germ or stem cell prior to or during differentiation.

The present invention also provides methods and composition useful for treating infertility. Human germline cells (e.g., spermatogonia cells, their progenitors or descendants) are capable of indefinite proliferation and characterized by high telomerase activity. Abnormal or diminished levels of hTRT gene products can result, for example, in inadequate or abnormal production of spermatozoa, leading to infertility or disorders of reproduction. Accordingly, "telomerase-based" infertility can be treated using the methods and compositions described herein to increase telomerase levels. Similarly, because inhibition of telomerase may negatively impact spermatogenesis, oogenesis, and sperm and egg viability, the telomerase inhibitory compositions of the invention can have contraceptive effects when used to reduce hTRT gene product levels in germline cells.

Further, the invention provides methods and composition useful for decreasing the proliferative potential of telomerase-positive cells such as activated lymphocytes and hematopoietic stem cells by reducing telomerase activity. Thus, the invention provide means for effecting immunosuppression. Conversely, the methods and reagents of the invention are useful for increasing telomerase activity and proliferative potential in cells, such as stem cells, that express a low level of telomerase or no telomerase prior to therapeutic intervention.

D) Modes of Intervention

As is clear from the foregoing discussion, modulation of the level of telomerase or telomerase activity of a cell can have a profound effect on the proliferative potential of the cell, and so has great utility in treatment of disease. As is also clear, this modulation may be either a decrease in telomerase activity or an increase in activity. The telomerase modulatory molecules of the invention can act through a number of mechanisms; some of these are described in this and the following subsections to aid the practitioner in selecting therapeutic agents. However, applicants do not intend to be limited to any particular mechanism of action for the novel therapeutic compounds, compositions and methods described herein.

Telomerase activity may be decreased through any of several mechanisms or combinations of mechanisms. One mechanism is the reduction of hTRT gene expression to reduce telomerase activity. This reduction can be at the level of transcription of the hTRT gene into mRNA, processing (e.g., splicing), nuclear transport or stability of mRNA, translation of mRNA to produce hTRT protein, or stability and function of hTRT protein. Another mechanism is interference with one or more activities of telomerase (e.g., the reverse transcriptase catalytic activity, or the hTR-binding activity) using inhibitory nucleic acids, polypeptides, or other agents (e.g., mimetics, small molecules, drugs and pro-drugs) that can be identified using the methods, or are provided by compositions, disclosed herein. Other mechanisms include sequestration of hTR and/or telomerase associated proteins, and interference with the assembly of the telomerase RNP from its component subunits. In a related mechanism, an hTRT promoter sequence is operably linked to a gene encoding a toxin and introduced into a cell; if or when hTRT transcriptional activators are expressed or activated in the cell, the toxin will be expressed, resulting in specific cell killing.

A related method for reducing the proliferative capacity of a cell involves introducing an hTRT variant with low fidelity (i.e., one with a high, e.g., greater than 1%, error rate) such that aberrant telomeric repeats are synthesized. These aberrant repeats affect telomere protein binding and lead to chromosomal rearrangements and aberrations and/or lead to cell death.

Similarly, telomerase activity may be increased through any of several mechanisms, or a combination of mechanisms. These include increasing the amount of hTRT in a cell. Usually this is carried out by introducing an hTRT polypeptide-encoding polynucleotide into the cell (e.g., a recombinantly produced polypeptide comprising an hTRT DNA sequence operably linked to a promoter, or a stable hTRT mRNA). Alternatively, a catalytically active hTRT polypeptide can itself be introduced into a cell or tissue, e.g., by microinjection or other means known in the art. In other mechanisms, expression from the endogenous hTRT gene or the stability of hTRT gene products in the cell can be increased. Telomerase activity in a cell can also be increased by interfering with the interaction of endogenous telomerase inhibitors and the telomerase RNP, or endogenous hTRT transcription repressors and the hTRT gene; by increasing expression or activity of hTRT transcription activators; and other means apparent to those of skill upon review of this disclosure.

E) Intervention Agents

1) TRT Proteins & Peptides

In one embodiment, the invention provides telomerase modulatory polypeptides (i.e., proteins, polypeptides, and peptides) that increase or reduce telomerase activity which can be introduced into a target cell directly (e.g., by injection, liposome-mediated fusion, application of a hydrogel to the tumor [e.g., melanoma] surface, fusion or attachment to herpes virus structural protein VP22, and other means described herein and known in the art). In a second embodiment, telomerase modulatory proteins and peptides of the invention are expressed in a cell by introducing a nucleic acid (e.g., a DNA expression vector or mRNA) encoding the desired protein or peptide into the cell. Expression may be either constitutive or inducible depending on the vector and choice of promoter (see discussion below). Messenger RNA preparations encoding hTRT are especially useful when only transient expression (e.g., transient activation of telomerase) is desired. Methods for introduction and expression of nucleic acids into a cell are well known in the art (also, see elsewhere in this specification, e.g., sections on oligonucleotides, gene therapy methods).

In one aspect of the invention, a telomerase modulatory polypeptide that increases telomerase activity in a cell is provided. In one embodiment, the polypeptide is a catalytically active hTRT polypeptide capable of directing the synthesis (in conjunction with an RNA template such as hTR) of human telomeric DNA. This activity can be measured, as discussed above, e.g., using a telomerase activity assay such as a TRAP assay. In one embodiment, the polypeptide is a full-length hTRT protein, having a sequence of, or substantially identical to, the sequence of 1132 residues of SEQ ID NO:2. In another embodiment, the polypeptide is a variant of the hTRT protein of SEQ ID NO:2, such as a fusion polypeptide, derivatized polypeptide, truncated polypeptide, conservatively substituted polypeptide, activity-modified polypeptide, or the like. A fusion or derivatized protein may include a targeting moiety that increases the ability of the polypeptide to traverse a cell membrane or causes the polypeptide to be delivered to a specified cell type (e.g., liver cells or tumor cells) preferentially or cell compartment (e.g., nuclear compartment) preferentially. Examples of targeting moieties include lipid tails, amino acid sequences such as antennapoedia peptide or a nuclear localization signal (NLS; e.g., *Xenopus* nucleoplasmin Robbins et al., 1991, *Cell* 64:615). Naturally occurring hTRT protein (e.g., having a sequence of or substantially identical to, SEQ ID NO:2) acts in the cell nucleus. Thus, it is likely that one or more subsequences of SEQ ID NO:2, such as residues 193-196 (PRRR SEQ ID NO:541) and residues 235-240 (PKRPRR SEQ ID NO: 542) act as a nuclear localization signal. The small regions are likely NLSs based on the observation that many NLSs comprise a 4 residue pattern composed of basic amino acids (K or R), or composed of three basic amino acids (K or R) and H or P; a pattern starting with P and followed within 3 residues by a basic segment containing 3 K or R residues out of 4 residues (see, e.g., Nakai et al., 1992, *Genomics* 14:897). Deletion of one or both of these sequences and/or additional localization sequences is expected to interfere with hTRT transport to the nucleus and/or increase hTRT turnover, and is useful for preventing access of telomerase to its nuclear substrates and decreasing proliferative potential. Moreover, a variant hTRT polypeptide lacking NLS may assemble into an RNP that will not be able to maintain telomere length, because the resulting enzyme cannot enter the nucleus.

The hTRT polypeptides of the invention will typically be associated in the target cell with a telomerase RNA, such as hTR, especially when they are used to increase telomerase activity in a cell. In one embodiment, an introduced hTRT polypeptide associates with an endogenous hTR to form a catalytically active RNP (e.g., an RNP comprising the hTR and a full-length polypeptide having a sequence of SEQ ID NO:2). The RNP so-formed may also associate with other, e.g., telomerase-associated, proteins. In other embodiments, telomerase RNP (containing hTRT protein, hTR and optionally other components) is introduced as a complex to the target cell.

In a related embodiment, an hTRT expression vector is introduced into a cell (or progeny of a cell) into which a telomerase RNA (e.g., hTR) expression vector is simultaneously, subsequently or has been previously introduced. In this embodiment, hTRT protein and telomerase RNA are coexpressed in the cell and assemble to form a telomerase RNP. A preferred telomerase RNA is hTR. An expression vector useful for expression of hTR in a cell is described supra (see U.S. Pat. No. 5,583,016). In yet another embodiment, the hTRT polypeptide and hTR RNA (or equivalent) are associated in vitro to form a complex, which is then introduced into the target cells, e.g., by liposome mediated transfer.

In another aspect, the invention provides hTRT polypeptides useful for reducing telomerase activity in a cell. As above, these "inhibitory" polypeptides can be introduced directly, or by expression of recombinant nucleic acids in the cell. It will be recognized that peptide mimetics or polypeptides comprising nonstandard amino acids (i.e., other than the 20 amino acids encoded by the genetic code or their normal derivatives) will typically be introduced directly.

In one embodiment, inhibition of telomerase activity results from the sequestration of a component required for accurate telomere elongation. Examples of such components are hTRT and hTR. Thus, administration of a polypeptide that binds hTR, but which does not have telomerase catalytic activity, can reduce endogenous telomerase activity in the cell. In a related embodiment, the hTRT polypeptide may bind a cell component other than hTR, such as one or more telomerase-associated proteins, thereby interfering with telomerase activity in the cell.

In another embodiment, hTRT polypeptides of the invention interfere (e.g., by competition) with the interaction of endogenously expressed hTRT protein and another cellular component required for telomerase function, such as hTR, telomeric DNA, telomerase-associated proteins, telomere-associated proteins, telomeres, cell cycle control proteins, DNA repair enzymes, histone or non-histone chromosomal proteins, or others.

In selecting molecules (e.g., polypeptides) of the invention that affect the interaction of endogenously expressed hTRT protein and other cellular components, one may prefer molecules that include one or more of the conserved motifs of the hTRT protein, as described herein. The evolutionary conservation of these regions indicates the important function in the proper functioning of human telomerase contributed by these motifs, and the motifs are thus generally useful sites for changing hTRT protein function to create variant hTRT proteins of the invention. Thus, variant hTRT polypeptides having mutations in conserved motifs will be particularly useful for some applications of the invention.

In another embodiment, expression of the endogenous hTRT gene is repressed by introduction into the cell of a large amount of hTRT polypeptide (e.g., typically at least about 2-fold more than the endogenous level, more often at least about 10- to about 100-fold) which acts via a feedback loop to inhibit transcription of the hTRT gene, processing of the hTRT pre-mRNA, translation of the hTRT mRNA, or assembly and transport of the telomerase RNP.

2) Oligonucleotides
a) Antisense Constructs

The invention provides methods and antisense oligonucleotide or polynucleotide reagents which can be used to reduce expression of hTRT gene products in vitro or in vivo. Administration of the antisense reagents of the invention to a target cell results in reduced telomerase activity, and is particularly useful for treatment of diseases characterized by high telomerase activity (e.g., cancers). Without intending to be limited to any particular mechanism, it is believed that antisense oligonucleotides bind to, and interfere with the translation of, the sense hTRT mRNA. Alternatively, the antisense molecule may render the hTRT mRNA susceptible to nuclease digestion, interfere with transcription, interfere with processing, localization or otherwise with RNA precursors ("pre-mRNA"), repress transcription of mRNA from the hTRT gene, or act through some other mechanism. However, the particular mechanism by which the antisense molecule reduces hTRT expression is not critical.

The antisense polynucleotides of the invention comprise an antisense sequence of at least 7 to 10 to typically 20 or more nucleotides that specifically hybridize to a sequence from mRNA encoding hTRT or mRNA transcribed from the hTRT gene. More often, the antisense polynucleotide of the invention is from about 10 to about 50 nucleotides in length or from about 14 to about 35 nucleotides in length. In other embodiments, antisense polynucleotides are polynucleotides of less than about 100 nucleotides or less than about 200 nucleotides. In general, the antisense polynucleotide should be long enough to form a stable duplex but short enough, depending on the mode of delivery, to administer in vivo, if desired. The minimum length of a polynucleotide required for specific hybridization to a target sequence depends on several factors, such as G/C content, positioning of mismatched bases (if any), degree of uniqueness of the sequence as compared to the population of target polynucleotides, and chemical nature of the polynucleotide (e.g., methylphosphonate backbone, peptide nucleic acid, phosphorothioate), among other factors.

Generally, to assure specific hybridization, the antisense sequence is substantially complementary to the target hTRT mRNA sequence. In certain embodiments, the antisense sequence is exactly complementary to the target sequence. The antisense polynucleotides may also include, however, nucleotide substitutions, additions, deletions, transitions, transpositions, or modifications, or other nucleic acid sequences or non-nucleic acid moieties so long as specific binding to the relevant target sequence corresponding to hTRT RNA or its gene is retained as a functional property of the polynucleotide.

In one embodiment, the antisense sequence is complementary to relatively accessible sequences of the hTRT mRNA (e.g., relatively devoid of secondary structure). This can be determined by analyzing predicted RNA secondary structures using, for example, the MFOLD program (Genetics Computer Group, Madison Wis.) and testing in vitro or in vivo as is known in the art. Examples of oligonucleotides that may be tested in cells for antisense suppression of hTRT function are those capable of hybridizing to (i.e., substantially complementary to) the following positions from SEQ ID NO:1: 40-60; 260-280; 500-520; 770-790; 885-905; 1000-1020; 1300-1320; 1520-1540; 2110-2130; 2295-2315; 2450-2470; 2670-2690; 3080-3110; 3140-3160; and 3690-3710. Another useful method for identifying effective antisense compositions uses combinatorial arrays of oligonucleotides (see, e.g., Milner et al., 1997, *Nature Biotechnology* 15:537).

The invention also provides an antisense polynucleotide that has sequences in addition to the antisense sequence (i.e., in addition to anti-hTRT-sense sequence). In this case, the antisense sequence is contained within a polynucleotide of longer sequence. In another embodiment, the sequence of the polynucleotide Consists essentially of, or is, the antisense sequence.

The antisense nucleic acids (DNA, RNA, modified, analogues, and the like) can be made using any suitable method for producing a nucleic acid, such as the chemical synthesis and recombinant methods disclosed herein. In one embodiment, for example, antisense RNA molecules of the invention may be prepared by de novo chemical synthesis or by cloning. For example, an antisense RNA that hybridizes to hTRT mRNA can be made by inserting (ligating) an hTRT DNA sequence (e.g., SEQ ID NO:1, or fragment thereof) in reverse orientation operably linked to a promoter in a vector (e.g., plasmid). Provided that the promoter and, preferably termination and polyadenylation signals, are properly positioned, the strand of the inserted sequence corresponding to the noncoding strand will be transcribed and act as an antisense oligonucleotide of the invention.

The antisense oligonucleotides of the invention can be used to inhibit telomerase activity in cell-free extracts, cells, and animals, including mammals and humans. For example, the phosphorothioate antisense oligonucleotides:

A) 5'-GGCATCGCGGGGGTGGCCGGG SEQ ID NO:506

B) 5'-CAGCGGGGAGCGCGCGGCATC SEQ ID NO:521

C) 5'-CAGCACCTCGCGGTAGTGGCT SEQ ID NO:522

D) 5'-GGACACCTGGCGGAAGGAGGG SEQ ID NO:507 can be used to inhibit telomerase activity. At 10 micromolar concentration each oligonucleotide, mixtures of oligonucleotides A and B; A, B, C, and D; and A, C, and D inhibited telomerase activity in 293 cells when treated once per day for seven days. Inhibition was also observed when an antisense hTR molecule (5'-GCTCTAGAATGAAGGGTG-3'; 3' SEQ ID NO:543) was used in combination with oligonucleotides A, B, and C; A, B, and D; and A and C. Useful control oligonucleotides in such experiments include:

S1) 5'-GCGACGACTGACATTGGCCGG SEQ ID NO:544

S2) 5'-GGCTCGAAGTAGCACCGGTGC SEQ ID NO:545

S3) 5'-GTGGGAACAGGCCGATGTCCC SEQ ID NO:546

To determine the optimum antisense oligonucleotide of the invention for the particular application of interest, one can perform a scan using antisense oligonucleotide sets of the invention. One illustrative set is the set of 30-mer oligonucleotides that span the hTRT mRNA and are offset one from the next by fifteen nucleotides (i.e., ON1 corresponds to positions 1-30 and is TCCCACGTGCGCAG-CAGGACGCAGCGCTGC (SEQ ID NO:547), ON2 corresponds to positions 16-45 and is GCCGGGGCCAGGGCTTCCCACGTGCGCAGC (SEQ ID NO:548), and ON3 corresponds to positions 31-60 and is GGCATCGCGGGGGTGGCCGGGGCCAGGGCT (SEQ ID NO:549), and so on to the end of the mRNA). Each member of this set can be tested for inhibitory activity as disclosed herein. Those oligonucleotides that show inhibitory activity under the conditions of interest then identify a region of interest, and other oligonucleotides of the invention corresponding to the region of interest (i.e., 8-mers, 10-mers, 15-mers, and so on) can be tested to identify the oligonucleotide with the preferred activity for the application.

Exemplary antisense oligonucleotides include 5'-GGCATCGCGGGGGTG GCCGGGGCCAGGGCT-3' (SEQ ID NO:722) (corresponding to nucleotide positions 31-60 of hTRT); 5'-GCGCA GCGTGCCAGCAGGT-GAACCAGCACG-3' (SEQ ID NO:723) (corresponding to positions 496-525); 5'- GCCCGTTCGCATCCCAGACGC-CTTCGGGGT-3' (SEQ ID NO:724) (corresponding to positions 631-660); and 5'-ACGCTATGGTTCCAGGCCCGT-TCGCATCCC-3' (SEQ ID NO:725) (corresponding to positions 646-675). When ACHN cells (NCI #503755) or 293 cells were treated for three days with 10 μM of phosphorothioate oligonucleotides with any of the four sequences supra, inhibition of telomerase activity by about 50%-90% (compared to control untreated cells) as measured by a TRAP assay, was observed.

For general methods relating to antisense polynucleotides, see ANTISENSE RNA AND DNA, (1988), D. A. Melton, Ed., Cold Spring Harbor Laboratory, Cold Spring Harbor, N.Y.). See also, Dagle et al., 1991, *Nucleic Acids Research,* 19:1805. For a review of antisense therapy, see, e.g., Uhlmann et al., *Chem. Reviews,* 90:543-584 (1990).

b) Triplex Oligo- and Polynucleotides

The present invention provides oligo- and polynucleotides (e.g., DNA, RNA, PNA or the like) that bind to double-stranded or duplex hTRT nucleic acids (e.g., in a folded region of the hTRT RNA or in the hTRT gene), forming a triple helix-containing, or "triplex" nucleic acid. Triple helix formation results in inhibition of hTRT expression by, for example, preventing transcription of the hTRT gene, thus reducing or eliminating telomerase activity in a cell. Without intending to be bound by any particular mechanism, it is believed that triple helix pairing compromises the ability of the double helix to open sufficiently for the binding of polymerases, transcription factors, or regulatory molecules to occur.

Triplex oligo- and polynucleotides of the invention are constructed using the base-pairing rules of triple helix formation (see, e.g., Cheng et al., 1988, *J. Biol. Chem.* 263: 15110; Ferrin and Camerini-Otero, 1991, *Science* 354:1494; Ramdas et al., 1989, *J. Biol. Chem.* 264:17395; Strobel et al., 1991, *Science* 254:1639; and Rigas et al., 1986, *Proc. Natl. Acad. Sci. U.S.A.* 83: 9591; each of which is incorporated herein by reference) and the hTRT mRNA and/or gene sequence. Typically, the triplex-forming oligonucleotides of the invention comprise a specific sequence of from about 10 to at least about 25 nucleotides or longer "complementary" to a specific sequence in the hTRT RNA or gene (i.e., large enough to form a stable triple helix, but small enough, depending on the mode of delivery, to administer in vivo, if desired). In this context, "complementary" means able to form a stable triple helix. In one embodiment, oligonucleotides are designed to bind specifically to the regulatory regions of the hTRT gene (e.g., the hTRT 5'-flanking sequence, promoters, and enhancers) or to the transcription initiation site, (e.g., between −10 and +10 from the transcription initiation site). For a review of recent therapeutic advances using triplex DNA, see Gee et al., in Huber and Carr, 1994, MOLECULAR AND IMMUNOLOGIC APPROACHES, Futura Publishing Co, Mt Kisco N.Y. and Rininsland et al., 1997, *Proc. Natl. Acad. Sci. USA* 94:5854, which are both incorporated herein by reference.

c) Ribozymes

The present invention also provides ribozymes useful for inhibition of telomerase activity. The ribozymes of the invention bind and specifically cleave and inactivate hTRT mRNA. Useful ribozymes can comprise 5'- and 3'-terminal sequences complementary to the hTRT mRNA and can be engineered by one of skill on the basis of the hTRT mRNA sequence disclosed herein (see PCT publication WO 93/23572, supra). Ribozymes of the invention include those having characteristics of group I intron ribozymes (Cech, 1995, *Biotechnology* 13:323) and others of hammerhead ribozymes (Edgington, 1992, *Biotechnology* 10:256).

Ribozymes of the invention include those having cleavage sites such as GUA, GUU and GUC. Other optimum cleavage sites for ribozyme-mediated inhibition of telomerase activity in accordance with the present invention include those described in PCT publications WO 94/02595 and WO 93/23569, both incorporated herein by reference. Short RNA oligonucleotides between 15 and 20 ribonucleotides in length corresponding to the region of the target hTRT gene containing the cleavage site can be evaluated for secondary structural features that may render the oligonucleotide more desirable. The suitability of cleavage sites may also be evaluated by testing accessibility to hybridization with complementary oligonucleotides using ribonuclease protection assays, or by testing for in vitro ribozyme activity in accordance with standard procedures known in the art.

As described by Hu et al., PCT publication WO 94/03596, incorporated herein by reference, antisense and ribozyme functions can be combined in a single oligonucleotide. Moreover, ribozymes can comprise one or more modified nucleotides or modified linkages between nucleotides, as described above in conjunction with the description of illustrative antisense oligonucleotides of the invention.

In one embodiment, the ribozymes of the invention are generated in vitro and introduced into a cell or patient. In another embodiment, gene therapy methods are used for expression of ribozymes in a target cell ex vivo or in vivo.

d) Administration of Oligonucleotides

Typically, the therapeutic methods of the invention involve the administration of an oligonucleotide that functions to inhibit or stimulate telomerase activity under in vivo physiological conditions, and is relatively stable under those conditions for a period of time sufficient for a therapeutic effect. As noted above, modified nucleic acids may be useful in imparting such stability, as well as for targeting delivery of the oligonucleotide to the desired tissue, organ, or cell.

Oligo- and poly-nucleotides can be delivered directly as a drug in a suitable pharmaceutical formulation, or indirectly by means of introducing a nucleic acid into a cell, including liposomes, immunoliposomes, ballistics, direct uptake into cells, and the like as described herein. For treatment of disease, the oligonucleotides of the invention will be administered to a patient in a therapeutically effective amount. A therapeutically effective amount is an amount sufficient to ameliorate the symptoms of the disease or modulate telomerase activity in the target cell, e.g., as can be measured using a TRAP assay or other suitable assay of telomerase biological function. Methods useful for delivery of oligonucleotides for therapeutic purposes are described in U.S. Pat. No. 5,272,065, incorporated herein by reference. Other details of administration of pharmaceutically active compounds are provided below. In another embodiment, oligo- and poly-nucleotides can be delivered using gene therapy and recombinant DNA expression plasmids of the invention.

3) Gene Therapy

Gene therapy refers to the introduction of an otherwise exogenous polynucleotide which produces a medically useful phenotypic effect upon the (typically) mammalian cell(s) into which it is transferred. In one aspect, the present invention provides gene therapy methods and compositions for treatment of telomerase-associated conditions. In illustrative embodiments, gene therapy involves introducing into a cell a vector that expresses an hTRT gene product (such as an hTRT protein substantially similar to the hTRT polypeptide having a sequence of SEQUENCE ID NO: 2, e.g., to increase telomerase activity, or an inhibitory hTRT polypeptide to reduce activity), expresses a nucleic acid having an hTRT gene or mRNA sequence (such as an antisense RNA, e.g., to reduce telomerase activity), expresses a polypeptide or polynucleotide that otherwise affects expression of hTRT gene products (e.g., a ribozyme directed to hTRT mRNA to reduce telomerase activity), or replaces or disrupts an endogenous hTRT sequence (e.g., gene replacement and "gene knockout," respectively). Numerous other embodiments will be evident to one of skill upon review of the disclosure herein. In one embodiment, a vector encoding hTR is also introduced. In another embodiment, vectors encoding telomerase-associated proteins are also introduced with or without a vector for hTR.

Vectors useful in hTRT gene therapy can be viral or nonviral, and include those described supra in relation to the hTRT expression systems of the invention. It will be understood by those of skill in the art that gene therapy vectors may comprise promoters and other regulatory or processing sequences, such as are described in this disclosure. Usually the vector will comprise a promoter and, optionally, an enhancer (separate from any contained within the promoter sequences) that serve to drive transcription of an oligoribonucleotide, as well as other regulatory elements that provide for episomal maintenance or chromosomal integration and for high-level transcription, if desired. A plasmid useful for gene therapy can comprise other functional elements, such as selectable markers, identification regions, and other sequences. The additional sequences can have roles in conferring stability both outside and within a cell, targeting delivery of hTRT nucleotide sequences (sense or antisense) to a specified organ, tissue, or cell population, mediating entry into a cell, mediating entry into the nucleus of a cell and/or mediating integration within nuclear DNA. For example, aptamer-like DNA structures, or other protein binding moieties sites can be used to mediate binding of a vector to cell surface receptors or to serum proteins that bind to a receptor thereby increasing the efficiency of DNA transfer into the cell. Other DNA sites and structures can directly or indirectly bind to receptors in the nuclear membrane or to other proteins that go into the nucleus, thereby facilitating nuclear uptake of a vector. Other DNA sequences can directly or indirectly affect the efficiency of integration.

Suitable gene therapy vectors may, or may not, have an origin of replication. For example, it is useful to include an origin of replication in a vector for propagation of the vector prior to administration to a patient. However, the origin of replication can often be removed before administration if the vector is designed to integrate into host chromosomal DNA or bind to host mRNA or DNA. In some situations (e.g., tumor cells) it may not be necessary for the exogenous DNA to integrate stably into the transduced cell, because transient expression may suffice to kill the tumor cells.

As noted, the present invention also provides methods and reagents for gene replacement therapy (i.e., replacement by homologous recombination of an endogenous hTRT gene with a recombinant gene). Vectors specifically designed for integration by homologous recombination may be used. Important factors for optimizing homologous recombination include the degree of sequence identity and length of homology to chromosomal sequences. The specific sequence mediating homologous recombination is also important, because integration occurs much more easily in transcriptionally active DNA. Methods and materials for constructing homologous targeting constructs are described by e.g., Mansour et al., 1988, *Nature* 336: 348; Bradley et al., 1992, *Bio/Technology* 10: 534. See also, U.S. Pat. Nos. 5,627,059; 5,487,992; 5,631,153; and 5,464,764. In one embodiment, gene replacement therapy involves altering or replacing all or a portion of the regulatory sequences controlling expression of the hTRT gene that is to be regulated. For example, the hTRT promoter sequences (e.g., such as are found in SEQ ID NO:6) may be disrupted (to decrease hTRT expression or to abolish a transcriptional control site) or an exogenous promoter (e.g., to increase hTRT expression) substituted.

The invention also provides methods and reagents for hTRT "gene knockout" (i.e., deletion or disruption by homologous recombination of an endogenous hTRT gene using a recombinantly produced vector). In gene knockout, the targeted sequences can be regulatory sequences (e.g., the hTRT promoter), or RNA or protein coding sequences. The use of homologous recombination to alter expression of endogenous genes is described in detail in U.S. Pat. No. 5,272,071 (and the U.S. patents cited supra), WO 91/09955, WO 93/09222, WO 96/29411, WO 95/31560, and WO 91/12650. See also, Moynahan et al., 1996, *Hum. Mol. Genet.* 5:875.

The invention further provides methods for specifically killing telomerase-positive cells, or preventing transformation of telomerase negative cells to a telomerase positive state, using the hTRT gene promoter to regulate expression of a protein toxic to the cell. As shown in Example 14, an hTRT promoter sequence may be operably linked to a reporter gene such that activation of the promoter results in expression of the protein encoded by the reporter gene. If, instead of a reporter protein, the encoded protein is toxic to the cell, activation of the promoter leads to cell morbidity or death. In one embodiment of the present invention, a vector comprising an hTRT promoter operably linked to a gene encoding a toxic protein is introduced into cells, such as human cells, e.g., cells in a human patient, resulting in cell death of cells in which hTRT promoter activating factors are expressed, such as cancer cells. In a related embodiment, the encoded protein is not itself toxic to a cell, but encodes an activity that renders the cell sensitive to an otherwise nontoxic drug. For example, tumors can be treated by introducing an hTRT-promoter-Herpes thymidine kinase (TK) gene fusion construct into tumor cells, and administering gancyclovir or the equivalent (see, e.g., Moolton and Wells, 1990, *J. Nat'l Canc. Inst.* 82:297). The art knows of numerous other suitable toxic or potentially toxic proteins and systems (using promoter sequences other that hTRT) that may be modified and applied in accordance with the present invention by one of skill in the art upon review of this disclosure.

Gene therapy vectors may be introduced into cells or tissues in vivo, in vitro or ex vivo. For ex vivo therapy, vectors may be introduced into cells, e.g., stem cells, taken from the patient and clonally propagated for autologous transplant back into the same patient (see, e.g., U.S. Pat. Nos. 5,399,493 and 5,437,994, the disclosures of which are herein incorporated by reference). Cells that can be targeted for hTRT gene therapy aimed at increasing the telomerase activity of target cell include, but are not limited to, embryonic stem or germ cells, particularly primate or human cells, as noted supra, hematopoietic stem cells (AIDS and post-chemotherapy), vascular endothelial cells (cardiac and cerebral vascular disease), skin fibroblasts and basal skin keratinocytes (wound healing and burns), chondrocytes (arthritis), brain astrocytes and microglial cells (Alzheimer's Disease), osteoblasts (osteoporosis), retinal cells (eye diseases), and pancreatic islet cells (Type I diabetes) and any of the cells listed in Table 3, infra, as well as any other cell types known to divide.

In one embodiment of the invention, an inducible promoter operably linked to a TRT, such as hTRT, coding sequence (or variant) is used to modulate the proliferative capacity of cells in vivo or in vitro. In a particular embodiment, for example, insulin-producing pancreatic cells transfected with an hTRT expression vector under the control of an inducible promoter are introduced into a patient. The proliferative capacity of the cells can then be controlled by administration to the patient of the promoter activating agent (e.g., tetracycline) to enable the cells to multiply more than otherwise would have been possible. Cell proliferation can then be terminated, continued, or reinitiated as desired by the treating physician.

4) Vaccines and Antibodies

Immuogenic peptides or polypeptides having an hTRT sequence can be used to elicit an anti-hTRT immune response in a patient (i.e., act as a vaccine). Exemplary immunogenic hTRT peptides and polypeptides are described infra in Examples 6 and 8. An immune response can also be raised by delivery of plasmid vectors encoding the polypeptide of interest (i.e., administration of "naked DNA"). The nucleic acids of interest can be delivered by injection, liposomes, or other means of administration. In one embodiment, immunization modes that elicit in the subject a Class I MHC restricted cytotoxic lymphocyte response against telomerase expressing cells are chosen. Once immunized, the individual or animal will elicit a heightened immune response against cells expressing high levels of telomerase (e.g., malignant cells).

Anti-hTRT antibodies, e.g., murine, human, or humanized monoclonal antibodies may also be administered to a patient (e.g., passive immunization) to effect an immune response against telomerase-expressing cells.

F.) Pharmaceutical Compositions

In related aspects, the invention provides pharmaceutical compositions that comprise hTRT oligo- and poly-nucleotides, polypeptides, and antibodies, agonists, antagonists, or inhibitors, alone or in combination with at least one other agent, such as a stabilizing compound, diluent, carrier, or another active ingredient or agent.

The therapeutic agents of the invention may be administered in any sterile, biocompatible pharmaceutical carrier, including, but not limited to, saline, buffered saline, dextrose, and water. Any of these molecules can be administered to a patient alone, or in combination with other agents, drugs or hormones, in pharmaceutical compositions where it is mixed with suitable excipient(s), adjuvants, and/or pharmaceutically acceptable carriers. In one embodiment of the present invention, the pharmaceutically acceptable carrier is pharmaceutically inert.

Administration of pharmaceutical compositions is accomplished orally or parenterally. Methods of parenteral delivery include topical, intra-arterial (e.g., directly to the tumor), intramuscular, subcutaneous, intramedullary, intrathecal, intraventricular, intravenous, intraperitoneal, or intranasal administration. In addition to the active ingredients, these pharmaceutical compositions may contain suitable pharmaceutically acceptable carriers comprising excipients and other compounds that facilitate processing of the active compounds into preparations which can be used pharmaceutically. Further details on techniques for formulation and administration may be found in the latest edition of "REMINGTON'S PHARMACEUTICAL SCIENCES" (Maack Publishing Co, Easton Pa.).

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, etc., suitable for ingestion by the patient. See PCT publication WO 93/23572.

Pharmaceutical preparations for oral use can be obtained through combination of active compounds with solid excipient, optionally grinding a resulting mixture, and processing the mixture of granules, after adding suitable additional compounds, if desired, to obtain tablets or dragee cores. Suitable excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethyl-cellulose; and gums including arabic and tragacanth; as well as proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound (i.e., dosage).

Pharmaceutical preparations which can be used orally include push-fit capsules made of gelatin, as well as soft, sealed capsules made of gelatin and a coating such as glycerol or sorbitol. Push-fit capsules can contain active ingredients mixed with a filler or binders such as lactose or starches, lubricants such as talc or magnesium stearate, and, optionally, stabilizers. In soft capsules, the active compounds may be dissolved or suspended in suitable liquids, such as fatty oils, liquid paraffin, or liquid polyethylene glycol with or without stabilizers.

Pharmaceutical formulations for parenteral administration include aqueous solutions of active compounds. For injection, the pharmaceutical compositions of the invention may be formulated in aqueous solutions, preferably in physiologically compatible buffers such as Hank's solution, Ringer's solution, or physiologically buffered saline. Aqueous injection suspensions may contain substances which increase the viscosity of the suspension, such as sodium carboxymethyl cellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For topical or nasal administration, penetrants appropriate to the particular barrier to be permeated are used in the formulation. Such penetrants are generally known in the art.

The pharmaceutical compositions of the present invention may be manufactured in a manner similar to that known in the art (e.g., by means of conventional mixing, dissolving, granulating, dragee-making, levigating, emulsifying, encapsulating, entrapping or lyophilizing processes).

The pharmaceutical composition may be provided as a salt and can be formed with many acids, including but not limited to hydrochloric, sulfuric, acetic, lactic, tartaric, malic, succinic, etc. Salts tend to be more soluble in aqueous or other protonic solvents that are the corresponding free base forms. In other cases, the preferred preparation may be a lyophilized powder in 1 mM-50 mM histidine, 0.1%-2% sucrose, 2%-7% mannitol at a pH range of 4.5 to 5.5, that is combined with buffer prior to use.

After pharmaceutical compositions comprising a compound of the invention formulated in a acceptable carrier have been prepared, they can be placed in an appropriate container and labeled for treatment of an indicated condition. For administration of human telomerase proteins and nucleic acids, such labeling would include amount, frequency and method of administration.

Pharmaceutical compositions suitable for use in the present invention include compositions wherein the active ingredients are contained in an effective amount to achieve the intended purpose. "Therapeutically effective amount" or "pharmacologically effective amount" are well recognized phrases and refer to that amount of an agent effective to produce the intended pharmacological result. Thus, a therapeutically effective amount is an amount sufficient to ameliorate the symptoms of the disease being treated. One useful assay in ascertaining an effective amount for a given application (e.g., a therapeutically effective amount) is measuring the effect on telomerase activity in a target cell. The amount actually administered will be dependent upon the individual to which treatment is to be applied, and will preferably be an optimized amount such that the desired effect is achieved without significant side-effects. The determination of a therapeutically effective dose is well within the capability of those skilled in the art.

For any compound, the therapeutically effective dose can be estimated initially either in cell culture assays or in any appropriate animal model. The animal model is also used to achieve a desirable concentration range and route of administration. Such information can then be used to determine useful doses and routes for administration in humans.

A therapeutically effective amount refers to that amount of protein, polypeptide, peptide, antibody, oligo- or polynucleotide, agonist or antagonists which ameliorates the symptoms or condition. Therapeutic efficacy and toxicity of such compounds can be determined by standard pharmaceutical procedures in cell cultures or experimental animals (e.g., $ED_{50}$, the dose therapeutically effective in 50% of the population; and $LD_{50}$, the dose lethal to 50% of the population). The dose ratio between therapeutic and toxic effects is the therapeutic index, and it can be expressed as the ratio, $ED_{50}/LD_{50}$. Pharmaceutical compositions which exhibit large therapeutic indices are preferred. The data obtained from cell culture assays and animal studies is used in formulating a range of dosage for human use. The dosage of such compounds lies preferably within a range of circulating concentrations that include the $ED_{50}$ with little or no toxicity. The dosage varies within this range depending upon the dosage form employed, sensitivity of the patient, and the route of administration.

The exact dosage is chosen by the individual physician in view of the patient to be treated. Dosage and administration are adjusted to provide sufficient levels of the active moiety or to maintain the desired effect. Additional factors which may be taken into account include the severity of the disease state (e.g., tumor size and location; age, weight and gender of the patient; diet, time and frequency of administration, drug combination(s), reaction sensitivities, and tolerance/response to therapy). Long acting pharmaceutical compositions might be administered every 3 to 4 days, every week, or once every two weeks depending on half-life and clearance rate of the particular formulation. Guidance as to particular dosages and methods of delivery is provided in the literature (see, U.S. Pat. Nos. 4,657,760; 5,206,344; and 5,225,212, herein incorporated by reference). Those skilled in the art will typically employ different formulations for nucleotides than for proteins or their inhibitors. Similarly, delivery of polynucleotides or polypeptides can be specific to particular cells, conditions, locations, and the like.

VIII. INCREASING PROLIFERATIVE CAPACITY AND PRODUCTION OF IMMORTALIZED CELLS, CELL LINES, AND ANIMALS

As discussed above, most vertebrate cells senesce after a finite number of divisions in culture (e.g., 50 to 100 divisions). Certain variant cells, however, are able to divide indefinitely in culture (e.g., HeLa cells, 293 cells) and, for this reason, are useful for research and industrial applications. Usually these immortal cell lines are derived from spontaneously arising tumors, or by transformation by exposure to radiation or a tumor-inducing virus or chemical. Unfortunately, a limited selection of cell lines, especially human cell lines representing differentiated cell function, is available. Moreover, the immortal cell lines presently available are characterized by chromosomal abnormalities (e.g., aneuploidy, gene rearrangements, or mutations). Further, many long-established cell lines are relatively undifferentiated (e.g., they do not produce highly specialized products of the sort that uniquely characterize particular tissues or organs). Thus, there is a need for new methods of generating immortal cells, especially human cells. As used herein, the term "immortalized cells" is not limited to cells that proliferate indefinitely, but may also include cells with increased proliferative capacity compared to similar wild-type cells. Depending on the cell type, increased proliferative capacity may mean proliferation for at least about 100, about 150, about 200, or about 400 or more generations, or for at least about 6, about 12, about 18, about 24 or about 36 or more months in in vitro culture. One use for immortalized cells is in production of natural proteins and recombinant proteins (e.g., therapeutic polypeptides such as erythropoietin, human growth hormone, insulin, and the like), or antibodies, for which a stable, genetically normal cell line is preferred. For production of some recombinant proteins, specialized cell types may also be preferred (e.g., pancreatic cells for the production of human insulin). Another use for immortalized cells or even mortal cells with increased proliferative capacity (relative to unmodified cells) is for introduction into a patient for gene therapy, or for replacement of diseased or damaged cells or tissue. For example, autologous immune cells containing or expressing a, e.g., recombinant hTRT gene or polypeptide of the invention can be used for cell replacement in a patient after aggressive cancer therapy, e.g., whole body irradiation. Another use for immortalized cells is for ex vivo production of "artificial" tissues or organs (e.g., skin) for therapeutic use. Another use for such cells is for screening or validation of drugs, such as telomerase-inhibiting drugs, or for use in production of vaccines or biological reagents. Additional uses of the cells of the invention will be apparent to those of skill.

The immortalized cells and cell lines, as well as those of merely increased replicative capacity, of the invention are made by increasing telomerase activity in the cell. Any method disclosed herein for increasing telomerase activity can be used. Thus, in one embodiment, cells are immortalized by increasing the amount of an hTRT polypeptide in the cell. In one embodiment, hTRT levels are increased by introducing an hTRT expression vector into the cell (with stable transfection sometimes preferred). As discussed above, the hTRT coding sequence is usually operably linked to a promoter, which may be inducible or constitutively active in the cell.

In one embodiment, a polynucleotide comprising a sequence encoding a polypeptide of SEQ ID NO:2, which sequence is operably linked to a promoter (e.g., a constitutively expressed promoter, e.g., a sequence of SEQ ID NO:6, is introduced into the cell. In one embodiment the polynucleotide comprises a sequence of SEQ ID NO:1. Preferably the polynucleotide includes polyadenylation and termination signals. In other embodiments, additional elements such as enhancers or others discussed supra are included. In an alternative embodiment, the polynucleotide does not include a promoter sequence, such sequence being provided by the target cell endogenous genome following integration (e.g., recombination, e.g., homologous recombination) of the introduced polynucleotide. The polynucleotide may be introduced into the target cell by any method, including any method disclosed herein, such as lipofection, electroporation, virosomes, liposomes, immunoliposomes, polycation: nucleic acid conjugates, naked DNA).

Using the methods of the invention, any vertebrate cell can be caused to have an increased proliferative capacity or even be immortalized and sustained indefinitely in culture. In one embodiment the cells are mammalian, with human cells preferred for many applications. Examples of human cells that can be immortalized include those listed in Table 3.

It will be recognized that the "diagnostic" assays of the invention described infra may be used to identify and characterize the immortalized cells of the invention.

TABLE 3

HUMAN CELLS IN WHICH hTRT EXPRESSION MAY BE INCREASED

Keratinizing Epithelial Cells keratinocyte of epidermis (differentiating epidermal cell)
basal cell of epidermis (stem cell)
keratinocyte of fingernails and toenails
basal cell of nail bed (stem cell)
hair shaft cells medullary, cortical, cuticular; hair-root sheath cells, cuticular, of Huxley's layer, of Henle's layer external;
hair matrix cell (stem cell)
Cells of Wet Stratified Barrier Epithelia surface epithelial cell of stratified squamous epithelium of tongue, oral cavity, esophagus, anal canal, distal urethra, vagina TABLE 3-continued HUMAN CELLS IN WHICH hTRT EXPRESSION MAY BE INCREASED basal cell of these epithelia (stem cell)
cell of external corneal epithelium
cell of urinary epithelium (lining bladder and urinary ducts)
Epithelial Cells Specialized for Exocrine Secretion cells of salivary gland mucous cell (secretion rich in polysaccharide)
serous cell (secretion rich in glycoprotein enzymes) cell of von Ebner's gland in tongue (secretion to wash over taste buds)
cell of mammary gland, secreting milk
cell of lacrimal gland, secreting tears
cell of ceruminous gland of ear, secreting wax
cell of eccrine sweat gland, secreting glycoproteins (dark cell)
cell of eccrine sweat gland, secreting small molecules (clear cell)
cell of apocrine sweat gland (odoriferous secretion, sex-hormone sensitive)
cell of gland of Moll in eyelid (specialized sweat gland)
cell of sebaceous gland, secreting lipid-rich sebum
cell of Bowman's gland in nose (secretion to wash over olfactory epithelium)
cell of Brunner's gland in duodenum, secreting alkaline solution of mucus and enzymes
cell of seminal vesicle, secreting components of seminal fluid, including fructose (as fuel for swimming sperm)
cell of prostate gland, secreting other components of seminal fluid
cell of bulbourethral gland, secreting mucus
cell of Bartholin's gland, secreting vaginal lubricant
cell of gland of Littré, secreting mucus
cell of endometrium of uterus, secreting mainly carbohydrates
isolated goblet cell of respiratory and digestive tracts, secreting mucus
mucous cell of lining of stomach
zymogenic cell of gastric gland, secreting pepsinogen
oxyntic cell of gastric gland, secreting HCl
acinar cell of pancreas, secreting digestive enzymes and bicarbonate
Paneth cell of small intestine, secreting lysozyme
type II pneumocyte of lung, secreting surfactant
Clara cell of lung
Cells specialized for Secretion of Hormones cells of anterior pituitary, secreting
growth hormone, follicle-stimulating hormone, luteinizing hormone, prolactin, adrenocorticotropic hormone, and thyroid-stimulating hormone,
cell of intermediate pituitary, secreting
melanocyte-stimulating hormone
cells of posterior pituitary, secreting
oxytocin, vasopressin
cells of gut, secreting
serotonin, endorphin, somatostatin, gastrin, secretin, cholecystokinin, insulin and glucagon
cells of thyroid gland, secreting
thyroid hormone, calcitonin
cells of parathyroid gland, secreting
parathyroid hormone, oxyphil cell
cells of adrenal gland, secreting
epinephrine, norepinephrine, and steroid hormones;
mineralocorticoids
glucocorticoids
cells of gonads, secreting
testosterone (Leydig cell of testis)
estrogen (theca interna cell of ovarian follicle)
progesterone (corpus luteum cell of ruptured ovarian follicle)
cells of juxtaglomerular apparatus of kidney
juxtaglomerular cell (secreting renin)
macula densa cell
peripolar cell
mesangial cell TABLE 3-continued HUMAN CELLS IN WHICH hTRT EXPRESSION MAY BE INCREASED Epithelial Absorptive Cells in Gut, Exocrine Glands, and Urogenital Tract brush border cell of intestine (with microvilli)
striated duct cell of exocrine glands
gall bladder epithelial cell
brush border cell of proximal tubule of kidney
distal tubule cell of kidney
nonciliated cell of ductulus efferens
epididymal principal cell
epididymal basal cell Cells Specialized for Metabolism and Storage hepatocyte (liver cell)
fat cells white fat
brown fat
lipocyte of liver Epithelial Cells Serving Primarily a Barrier Function, Lining the Lung, Gut, Exocrine Glands, and Urogenital Tract type I pneumocyte (lining air space of lung)
pancreatic duct cell (centroacinar cell)
nonstriated duct cell of sweat gland, salivary gland, mammary gland
parietal cell of kidney glomerulus
podocyte of kidney glomerulus
cell of thin segment of loop of Henle (in kidney)
collecting duct cell (in kidney)
duct cell of seminal vesicle, prostate gland Epithelial Cells Lining Closed Internal Body Cavities vascular endothelial cells of blood vessels and lymphatics fenestrated
continuous
splenic
synovial cell (lining joint cavities, secreting largely hyaluronic acid)
serosal cell (lining peritoneal, pleural, and pericardial cavities)
squamous cell lining perilymphatic space of ear
cells lining endolymphatic space of ear
squamous cell columnar cells of endolymphatic sac with microvilli
without microvilli
"dark" cell
vestibular membrane cell (resembling choroid plexus cell)
stria vascularis basal cell
stria vascularis marginal cell
cell of Claudius
cell of Boettcher
choroid plexus cell (secreting cerebrospinal fluid)
squamous cell of pia-arachnoid cells of ciliary epithelium of eye pigmented
nonpigmented
corneal "endothelial" cell Ciliated Cells with Propulsive Function of respiratory tract
of oviduct and of endometrium of uterus (in female)
of rete testis and ductulus efferens (in male)
of central nervous system (ependymal cell lining brain cavities)

Cells Specialized for Secretion of Extracellular Matrix epithelial:

ameloblast (secreting enamel of tooth)
planum semilunatum cell of vestibular apparatus of ear (secreting proteoglycan)

TABLE 3-continued

HUMAN CELLS IN WHICH hTRT EXPRESSION MAY BE INCREASED interdental cell of organ of Corti (secreting tectorial "membrane" covering hair cells of organ of Corti)
nonepithelial (connective tissue)
fibroblasts (various-of loose connective tissue, of cornea, of tendon, of reticular tissue of bone marrow, etc.)
pericyte of blood capillary
nucleus pulposus cell of intervertebral disc
cementoblast/cementocyte (secreting bonelike cementum of root of tooth)
odontoblast/odontocyte (secreting dentin of tooth)
chondrocytes
of hyaline cartilage, of fibrocartilage, of elastic cartilage
osteoblast/osteocyte
osteoprogenitor cell (stem cell of osteoblasts)
hyalocyte of vitreous body of eye
stellate cell of perilymphatic space of ear Contractile Cells skeletal muscle cells red (slow)
white (fast)
intermediate
muscle spindleXXnuclear bag
muscle spindleXXnuclear chain
satellite cell (stem cell)
heart muscle cells ordinary
nodal
Purkinje fiber
smooth muscle cells
myoepithelial cells of iris
of exocrine glands Cells of Blood and Immune System red blood cell
megakaryocyte
macrophages monocyte
connective tissue macrophage (various)
Langerhans cell (in epidermis)
osteoclast (in bone)
dendritic cell (in lymphoid tissues)
microglial cell (in central nervous system)
neutrophil
eosinophil
basophil
mast cell T lymphocyte helper T cell
suppressor T cell
killer T cell
B lymphocyte IgM
IgG
IgA
IgE
killer cell
stem cells for the blood and immune system (various)

Sensory Transducers photoreceptors rod
cones blue sensitive
green sensitive
red sensitive

TABLE 3-continued

HUMAN CELLS IN WHICH hTRT EXPRESSION MAY BE INCREASED hearing inner hair cell of organ of Corti
outer hair cell of organ of Corti
acceleration and gravity type I hair cell of vestibular apparatus of ear
type II hair cell of vestibular apparatus of ear
taste
type 11 taste bud cell
smell olfactory neuron
basal cell of olfactory epithelium (stem cell for olfactory neurons)
blood Ph carotid body cell type I
type II
touch Merkel cell of epidermis
primary sensory neurons specialized for touch temperature
primary sensory neurons specialized for temperature cold sensitive
heat sensitive
pain
primary sensory neurons specialized for pain configurations
and forces in musculoskeletal system
proprioceptive primary sensory neurons
Autonomic Neurons cholinergic
adrenergic
peptidergic
Supporting Cells of Sense Organs and of Peripheral Neurons supporting cells of organ of Corti inner pillar cell
outer pillar cell
inner phalangeal cell
outer phalangeal cell
border cell
Hensen cell
supporting cell of vestibular apparatus
supporting cell of taste bud (type I taste bud cell)
supporting cell of olfactory epithelium
Schwann cell
satellite cell (encapsulating peripheral nerve cell bodies)
enteric glial cell
Neurons and Glial Cells of Central Nervous System neurons
glial cells astrocyte
oligodendrocyte
Lens Cells anterior lens epithelial cell
lens fiber (crystallin-containing cell)
Pigment Cells melanocyte, retinal pigmented epithelial cell
Germ Cells oogonium/oocyte
spermatocyte
spermatogonium (stem cell for spermatocyte)

TABLE 3-continued

HUMAN CELLS IN WHICH hTRT EXPRESSION MAY BE INCREASED

Nurse Cells ovarian follicle cell
Sertoli cell (in testis)
thymus epithelial cell
Stem Cells embryonic stem cell
embryonic germ cell adult stem cell
fetal stem cell

IX. Diagnostic Assays

A) Introduction

1) TRT Assays

The present invention provides a wide variety of assays for TRT, preferably hTRT, and telomerase. These assays provide, inter alia, the basis for sensitive, inexpensive, convenient, and widely applicable assays for diagnosis and prognosis of a number of human diseases, of which cancer is an illustrative example. As noted supra, hTRT gene products (protein and mRNA) are usually elevated in immortal human cells relative to most normal mortal cells (i.e., telomerase-negative cells and most telomerase-positive normal adult somatic cells). Thus, in one aspect, the invention provides assays useful for detecting or measuring the presence, absence, or quantity of an hTRT gene product in a sample from, or containing, human or other mammalian or eukayotic cells to characterize the cells as immortal (such as a malignant tumor cell) or mortal (such as most normal somatic cells in adults) or as telomerase positive or negative.

Any condition characterized by the presence or absence of an hTRT gene product (i.e., protein or RNA) may be diagnosed using the methods and materials described herein. These include, as described more fully below, cancers, other diseases of accelerated cell proliferation, immunological disorders, fertility, infertility, and others. Moreover, because the degree to which telomerase activity is elevated in cancer cells is correlated with characteristics of the tumor, such as metastatic potential, monitoring hTRT, mRNA or protein levels can be used to estimate and predict the likely future progression of a tumor.

In one aspect, the diagnostic and prognostic methods of the invention entail determining whether a human TRT gene product is present in a biological sample (e.g., from a patient). In a second aspect, the abundance of hTRT gene product in a biological sample (e.g., from a patient) is determined and compared to the abundance in a control sample (e.g., normal cells or tissues). In a third aspect, the cellular or intracellular localization of an hTRT gene product is determined in a cell or tissue sample. In a fourth aspect, host (e.g., patient) cells are assayed to identify nucleic acids with sequences characteristic of a heritable propensity for abnormal hTRT gene expression (abnormal quantity, regulation, or product), such as is useful in genetic screening or genetic counseling. In a fifth aspect, the assays of the invention are used detect the presence of anti-hTRT antibodies (e.g., in patient serum). The methods described below in some detail are indicative of useful assays that can be carried out using the sequences and relationships disclosed herein. However, numerous variations or other applications of these assays will be apparent to those of ordinary skill in the art in view of this disclosure.

It will be recognized that, although the assays below are presented in terms of diagnostic and prognostic methods, they may be used whenever an hTRT gene, gene product, or variant is to be detected, quantified, or characterized. Thus, for example, the "diagnostic" methods described infra are useful for assays of hTRT or telomerase during production and purification of hTRT or human telomerase, for characterization of cell lines derived from human cells (e.g., to identify immortal lines), for characterization of cells, non-human animals, plants, fungi, bacteria or other organisms that comprise a human TRT gene or gene product (or fragments thereof).

As used herein, the term "diagnostic" has its usual meaning of identifying the presence or nature of a disease (e.g., cancer), condition (e.g., infertile, activated), or status (e.g., fertile) and the term "prognostic" has its usual meaning of predicting the probable development and/or outcome of a disease or condition. Although these two terms are used in somewhat different ways in a clinical setting, it will be understood that any of the assays or assay formats disclosed below in reference to "diagnosis" are equally suitable for determination of prognosis because it is well established that higher telomerase activity levels are associated with poorer prognoses for cancer patients, and because the present invention provides detection methods specific for hTRT, which is expressed at levels that closely correlate with telomerase activity in a cell.

2) Diagnosis and Prognosis of Cancer

The determination of an hTRT gene, mRNA or protein level above normal or standard range is indicative of the presence of telomerase-positive cells, or immortal, of which certain tumor cells are examples. Because certain embryonic and fetal cells, as well as certain adult stem cells, express telomerase, the present invention also provides methods for determining other conditions, such as pregnancy, by the detection or isolation of telomerase positive fetal cells from maternal blood. These values can be used to make, or aid in making, a diagnosis, even when the cells would not have been classified as cancerous or otherwise detected or classified using traditional methods. Thus, the methods of the present invention permit detection or verification of cancerous or other conditions associated with telomerase with increased confidence, and at least in some instances at an earlier stage. The assays of the invention allow discrimination between different classes and grades of human tumors or other cell-proliferative diseases by providing quantitative assays for the hTRT gene and gene products and thereby facilitate the selection of appropriate treatment regimens and accurate diagnoses. Moreover, because levels of telomerase activity can be used to distinguish between benign and malignant tumors (e.g., U.S. Pat. No. 5,489,508; Hiyama et al., 1997, *Proc. Am Ass. Cancer Res.* 38:637), to predict immanence of invasion (e.g., U.S. Pat. No. 5,639,613; Yashima et al., 1997, *Proc. Am Ass. Cancer Res.* 38:326), and to correlate with metastatic potential (e.g., U.S. Pat. No. 5,648,215; Pandita et al, 1996, *Proc. Am Ass. Cancer Res.* 37:559), these assays will be useful for prophylaxis, detection, and treatment of a wide variety of human cancers.

For prognosis of cancers (or other diseases or conditions characterized by elevated telomerase), a prognostic value of hTRT gene product (mRNA or protein) or activity for a particular tumor type, class or grade, is determined as described infra. hTRT protein or mRNA levels or telomerase activity in a patient can also be determined (e.g., using the assays disclosed herein) and compared to the prognostic level.

Depending on the assay used, in some cases the abundance of an hTRT gene product in a sample will be considered elevated whenever it is detectable by the assay. Due to the low abundance of hTRT mRNA and protein even in telomerase-positive cells, and the rarity or non-existence of these gene products in normal or telomerase-negative cells, sensitive assays are required to detect the hTRT gene product if present at all in normal cells. If less sensitive assays are selected, hTRT gene products will be undetectable in healthy tissue but will be detectable in telomerase-positive cancer or other telomerase-positive cells. Typically, the amount of hTRT gene product in an elevated sample is at least about five, frequently at least about ten, more often at least about 50, and very often at least about 100 to 1000 times higher than the levels in telomerase-negative control cells or cells from healthy tissues in an adult, where the percentage of telomerase-positive normal cells is very low.

The diagnostic and prognostic methods of the present invention can be employed with any cell or tissue type of any origin and can be used to detect an immortal or neoplastic cell, or tumor tissue, or cancer, of any origin. Types of cancer that may be detected include, but are not limited to, all those listed supra in the discussion of therapeutic applications of hTRT.

The assays of the invention are also useful for monitoring the efficacy of therapeutic intervention in patients being treated with anticancer regimens. Anticancer regimens that can be monitored include all presently approved treatments (including chemotherapy, radiation therapy, and surgery) and also includes treatments to be approved in the future, such as telomerase inhibition or activation therapies as described herein. (See, e.g., See PCT Publication Nos. 96/01835 and 96/40868 and U.S. Pat. No. 5,583,016; all of which are incorporated by reference in their entirety).

In another aspect, the assays described below are useful for detecting certain variations in hTRT gene sequence (mutations and heritable hTRT alleles) that are indicative of a predilection for cancers or other conditions associated with abnormal regulation of telomerase activity (infertility, premature aging).

3) Diagnosis of Conditions Other than Cancer

In addition to diagnosis of cancers, the assays of the present invention have numerous other applications. The present invention provides reagents and methods/diagnosis of conditions or diseases characterized by under- or over-expression of telomerase or hTRT gene products in cells. In adults, a low level of telomerase activity is normally found in a limited complement of normal human somatic cells, e.g., stem cells, activated lymphocytes and germ cells, and is absent from other somatic cells. Thus, the detection of hTRT or telomerase activity in cells in which it is normally absent or inactive, or detection at abnormal (i.e., higher or lower than normal) levels in cells in which hTRT is normally present at a low level (such as stem cells, activated lymphocytes and germ cells), can be diagnostic of a telomerase-related disease or condition or used to identify or isolate a specific cell type (i.e., to isolate stem cells). Examples of such diseases and conditions include: diseases of cell proliferation, immunological disorders, infertility, diseases of immune cell function, pregnancy, fetal abnormalities, premature aging, and others. Moreover, the assays of the invention are useful for monitoring the effectiveness of therapeutic intervention (including but not limited to drugs that modulate telomerase activity) in a patient or in a cell- or animal-based assay.

In one aspect, the invention provides assays useful for diagnosing infertility. Human germ cells (e.g., spermatogonia cells, their progenitors or descendants) are capable of indefinite proliferation and characterized by high telomerase activity. Abnormal levels or products or diminished levels of hTRT gene products can result in inadequate or abnormal production of spermatozoa, leading to infertility or disorders of reproduction. Accordingly, the invention provides assays (methods and reagents) for diagnosis and treatment of "telomerase-based" reproductive disorders. Similarly, the assays can be used to monitor the efficacy of contraceptives (e.g., male contraceptives) that target or indirectly affect sperm production (and which would reduce hTRT levels or telomerase activity).

In another aspect, the invention provides assays for analysis of telomerase and hTRT levels and function in stem cells, fetal cells, embryonic cells, activated lymphocytes and hematopoietic stem cells. For example, assays for hTRT gene product detection can be used to monitor immune function generally (e.g., by monitoring the prevalence of activated lymphocytes or abundance of progenitor stem cells), to identify or select or isolate activated lymphocytes or stem cells (based on elevated hTRT levels), and to monitor the efficacy of therapeutic interventions targeting these tissues (e.g., immunosuppressive agents or therapeutic attempt to expand a stem cell population).

The invention also provides assays useful for identification of anti-telomerase and anti-TRT immunoglobulins (found in serum from a patient). The materials and assays described herein can be used to identify patients in which such autoimmune antibodies are found, permitting diagnosis and treatment of the condition associated with the immunoglobulins.

4) Monitoring Cells in Culture

The assays described herein are also useful for monitoring the expression of hTRT gene products and characterization of hTRT genes in cells ex vivo or in vitro. Because elevated hTRT levels are characteristic of immortalized cells, the assays of the invention can be used, for example, to screen for, or identify, immortalized cells or to identify an agent capable of mortalizing immortalized cells by inhibiting hTRT expression or function. For example, the assay will be useful for identifying cells immortalized by increased expression of hTRT in the cell, e.g., by the expression of a recombinant hTRT or by increased expression of an endogenously coded hTRT (e.g., by promoter activation).

Similarly, these assays may be used to monitor hTRT expression in transgenic animals or cells (e.g., yeast or human cells containing an hTRT gene). In particular, the effects of certain treatments (e.g., application of known or putative telomerase antagonists) on the hTRT levels in human and nonhuman cells expressing the hTRT of the invention can be used for identifying useful drugs and drug candidates (e.g., telomerase activity-modulating drugs).

B) Normal, Diagnostic, and Prognostic Values

Assays for the presence or quantity of hTRT gene products may be carried out and the results interpreted in a variety of ways, depending on the assay format, the nature of the sample being assayed, and the information sought. For example, the steady state abundance of hTRT gene products is so low in most human somatic tissues that they are undetectable by certain assays. Moreover, there is generally no telomerase activity in the cells of these tissues, making verification of activity quite easy. Conversely, hTRT protein and/or hTRT mRNA or telomerase is sufficiently abundant in other telomerase-positive tissues, e.g., malignant tumors, so that the same can be detected using the same assays. Even in those somatic cell types in which low levels of telomerase activity can normally be detected (e.g., stem cells, and certain activated hematopoietic system cells), the levels of hTRT mRNA and telomerase activity are a small fraction (e.g., estimated at about 1% or less) of the levels in immortal cells; thus, immortal and mortal cells may be easily distinguished by the methods of the present invention. It will be appreciated that, when a "less sensitive" assay is used, the mere detection of the hTRT gene product in a biological sample can itself be diagnostic, without the requirement for additional analysis. Moreover, although the assays described below can be made exquisitely sensitive, they may also, if desired, be made less sensitive (e.g., through judicious choice of buffers, wash conditions, numbers of rounds of amplification, reagents, and/or choice of signal amplifiers). Thus, virtually any assay can be designed so that it detects hTRT gene products only in biological samples in which they are present at a particular concentration, e.g. a higher concentration than in healthy or other control tissue. In this case, any detectable level of hTRT mRNA or protein will be considered elevated in cells from post-natal human somatic tissue (other than hematopoietic cells and other stem cells).

In some cases, however, it will be desirable to establish normal or baseline values (or ranges) for hTRT gene product expression levels, particularly when very sensitive assays capable of detecting very low levels of hTRT gene products that may be present in normal somatic cells are used. Normal levels of expression or normal expression products can be determined for any particular population, subpopulation, or group of organisms according to standard methods well known to those of skill in the art and employing the methods and reagents of the invention. Generally, baseline (normal) levels of hTRT protein or hTRT mRNA are determined by quantitating the amount of hTRT protein and/or mRNA in biological samples (e.g., fluids, cells or tissues) obtained from normal (healthy) subjects, e.g., a human subject. For certain samples and purposes, one may desire to quantitate the amount of hTRT gene product on a per cell, or per tumor cell, basis. To determine the cellularity of a sample, one may measure the level of a constitutively expressed gene product or other gene product expressed at known levels in cells of the type from which the sample was taken. Alternatively, normal values of hTRT protein or hTRT mRNA can be determined by quantitating the amount of hTRT protein/RNA in cells or tissues known to be healthy, which are obtained from the same patient from whom diseased (or possibly diseased) cells are collected or from a healthy individual. Alternatively, baseline levels can be defined in some cases as the level present in non-immortal human somatic cells in culture. It is possible that normal (baseline) values may differ somewhat between different cell types (for example, hTRT mRNA levels will be higher in testis than kidney), or according to the age, sex, or physical condition of a patient. Thus, for example, when an assay is used to determine changes in hTRT levels associated with cancer, the cells used to determine the normal range of hTRT gene product expression can be cells from persons of the same or a different age, depending on the nature of the inquiry. Application of standard statistical methods used in molecular genetics permits determination of baseline levels of expression, as well as permits identification of significant deviations from such baseline levels.

In carrying out the diagnostic and prognostic methods of the invention, as described above, it will sometimes be useful to refer to "diagnostic" and "prognostic values" As used herein, "diagnostic value" refers to a value that is determined for the hTRT gene product detected in a sample which, when compared to a normal (or "baseline") range of the hTRT gene product is indicative of the presence of a disease. The disease may be characterized by high telomerase activity (e.g., cancer), the absence of telomerase activity (e.g., infertility), or some intermediate value. "Prognostic value" refers to an amount of the hTRT gene product detected in a given cell type (e.g., malignant tumor cell) that is consistent with a particular diagnosis and prognosis for the disease (e.g., cancer). The amount (including a zero amount) of the hTRT gene product detected in a sample is compared to the prognostic value for the cell such that the relative comparison of the values indicates the presence of disease or the likely outcome of the disease (e.g., cancer) progression. In one embodiment, for example, to assess tumor prognosis, data are collected to obtain a statistically significant correlation of hTRT levels with different tumor classes or grades. A predetermined range of hTRT levels is established for the same cell or tissue sample obtained from subjects having known clinical outcomes. A sufficient number of measurements is made to produce a statistically significant value (or range of values) to which a comparison will be made. The predetermined range of hTRT levels or activity for a given cell or tissue sample can then be used to determine a value or range for the level of hTRT gene product that would correlate to favorable (or less unfavorable) prognosis (e.g., a "low level" in the case of cancer). A range corresponding to a "high level" correlated to an (or a more) unfavorable prognosis in the case of cancer can similarly be determined. The level of hTRT gene product from a biological sample (e.g., a patient sample) can then be determined and compared to the low and high ranges and used to predict a clinical outcome.

Although the discussion above refers to cancer for illustration, it will be understood that diagnostic and prognostic values can also be determined for other diseases (e.g., diseases of cell proliferation) and conditions and that, for diseases or conditions other than cancer, a "high" level may be correlated with the desired outcome and a "low" level correlated with an unfavorable outcome. For example, some diseases may be characterized by a deficiency (e.g., low level) of telomerase activity in stem cells, activated lymphocytes, or germline cells. In such cases, "high" levels of hTRT gene products relative to cells of similar age and/or type (e.g., from other patients or other tissues in a particular patient) may be correlated with a favorable outcome.

It will be appreciated that the assay methods do not necessarily require measurement of absolute values of hTRT, unless it is so desired, because relative values are sufficient for many applications of the methods of the present invention. Where quantitation is desirable, the present invention provides reagents such that virtually any known method for quantitating gene products can be used.

The assays of the invention may also be used to evaluate the efficacy of a particular therapeutic treatment regime in animal studies, in clinical trials, or in monitoring the treatment of an individual patient. In these cases, it may be desirable to establish the baseline for the patient prior to commencing therapy and to repeat the assays one or more times through the course of treatment, usually on a regular basis, to evaluate whether hTRT levels are moving toward the desired endpoint (e.g., reduced expression of hTRT when the assay is for cancer) as a result of the treatment.

One of skill will appreciate that, in addition to the quantity or abundance of hTRT gene products, variant or abnormal expression patterns (e.g., abnormal amounts of RNA splicing variants) or variant or abnormal expression products (e.g., mutated transcripts, truncated or non-sense polypeptides) may also be identified by comparison to normal expression levels and normal expression products. In these cases determination of "normal" or "baseline" involves identifying healthy organisms and/or tissues (i.e. organisms and/or tissues without hTRT expression disregulation or neoplastic growth) and measuring expression levels of the variant hTRT gene products (e.g., splicing variants), or sequencing or detecting the hTRT gene, mRNA, or reverse transcribed cDNA to obtain or detect typical (normal) sequence variations. Application of standard statistical methods used in molecular genetics permits determination of significant deviations from such baseline levels.

C) Detection and Quantitation of TRT Gene Products

As has been emphasized herein, hTRT gene products are usually found in most normal somatic cells at extremely low levels. For example, the mRNA encoding hTRT protein is extremely rare or absent in all telomerase-negative cell types studied thus far. In immortal cells, such as 293 cells, hTRT mRNA may be present at only about 100 copies per cell, while normal somatic cells may have as few as one or zero copies per cell. It will thus be apparent that, when highly sensitive assays for hTRT gene products are desired, it will sometimes be advantageous to incorporate signal or target amplification technologies into the assay format. See, for example, Plenat et al., 1997, *Ann. Pathol.* 17:17 (fluoresceinyl-tyramide signal amplification); Zehbe et al., 1997, *J. Pathol.* 150:1553 (catalyzed reporter deposition); other references listed herein (e.g., for bDNA signal amplification, for PCR and other target amplification formats); and other techniques known in the art.

As noted above, it is often unnecessary to quantitate the hTRT mRNA or protein in the assays disclosed herein, because the detection of an hTRT gene product (under assay conditions in which the product is not detectable in control, e.g., telomerase-negative cells) is in itself sufficient for a diagnosis. As another example, when the levels of product found in a test (e.g., tumor) and control (e.g., healthy cell) samples are directly compared, quantitation may be superfluous.

When desired, however, quantities of hTRT gene product measured in the assays described herein may be described in a variety of ways, depending on the method of measurement and convenience. Thus, normal, diagnostic, prognostic, high or low quantities of hTRT protein/mRNA may be expressed as standard units of weight per quantity of biological sample (e.g., picograms per gram tissue, picograms per $10^{12}$ cells), as a number of molecules per quantity of biological sample (e.g., transcripts/cell, moles/cell), as units of activity per cell or per other unit quantity, or by similar methods. The quantity of hTRT gene product can also be expressed in relation to the quantity of another molecule; examples include: number of hTRT transcripts in sample/number of 28S rRNA transcripts in sample; nanograms of hTRT protein/nanograms of total protein; and the like.

When measuring hTRT gene products in two (or more) different samples, it will sometimes be useful to have a common basis of comparison for the two samples. For example, when comparing a sample of normal tissue and a sample of cancerous tissue, equal amounts of tissue (by weight, volume, number of cells, etc.) can be compared. Alternatively, equivalents of a marker molecule (e.g., 28S rRNA, hTR, telomerase activity, telomere length, actin) may be used. For example, the amount of hTRT protein in a healthy tissue sample containing 10 picograms of 28S rRNA can be compared to a sample of diseased tissue containing the same amount of 28S rRNA.

It will also be recognized by those of skill that virtually any of the assays described herein can be designed to be quantitative. Typically, a known quantity or source of an hTRT gene product (e.g., produced using the methods and compositions of the invention) is used to calibrate the assay.

In certain embodiments, assay formats are chosen that detect the presence, absence, or abundance of an hTRT allele or gene product in each cell in a sample (or in a representative sampling). Examples of such formats include those that detect a signal by histology (e.g., immunohistochemistry with signal-enhancing or target-enhancing amplification steps) or fluorescence-activated cell analysis or cell sorting (FACS). These formats are particularly advantageous when dealing with a highly heterogeneous cell population (e.g., containing multiple cells types in which only one or a few types have elevated hTRT levels, or a population of similar cells expressing telomerase at different levels).

D) Sample Collection

The hTRT gene or gene product (i.e., mRNA or polypeptide) is preferably detected and/or quantified in a biological sample. Such samples include, but are not limited to, cells (including whole cells, cell fractions, cell extracts, and cultured cells or cell lines), tissues (including blood, blood cells (e.g., white cells), and tissue samples such as fine needle biopsy samples (e.g., from prostate, breast, thyroid, etc.)), body fluids (e.g., urine, sputum, amniotic fluid, blood, peritoneal fluid, pleural fluid, semen) or cells collected therefrom (e.g., bladder cells from urine, lymphocytes from blood), media (from cultured cells or cell lines), and washes (e.g., of bladder and lung). Biological samples may also include sections of tissues such as frozen sections taken for histological purposes. For cancer diagnosis and prognosis, a sample will be obtained from a cancerous or precancerous or suspected cancerous tissue or tumor. It will sometimes be desirable to freeze a biological sample for later analysis (e.g., when monitoring efficacy of drug treatments).

In some cases, the cells or tissues may be fractionated before analysis. For example, in a tissue biopsy from a patient, a cell sorter (e.g., a fluorescence-activated cell sorter) may be used to sort cells according to characteristics such as expression of a surface antigen (e.g., a tumor specific antigen) according to well known methods.

Although the sample is typically taken from a human patient or cell line, the assays can be used to detect hTRT homolog genes or gene products in samples from other animals. Alternatively, hTRT genes and gene products can be assayed in transgenic animals or organisms expressing a human TRT protein or nucleic acid sequence.

The sample may be pretreated as necessary by dilution in an appropriate buffer solution or concentrated, if desired. Any of a number of standard aqueous buffer solutions, employing one of a variety of buffers, such as phosphate, Tris-buffer, or the like, at physiological pH can be used.

A "biological sample" obtained from a patient can be referred to either as a "biological sample" or a "patient sample." It will be appreciated that analysis of a "patient sample" need not necessarily require removal of cells or tissue from the patient. For example, appropriately labeled hTRT-binding agents (e.g., antibodies or nucleic acids) can be injected into a patient and visualized (when bound to the target) using standard imaging technology (e.g., CAT, NMR, and the like.)

E) Nucleic Acid Assays

In one embodiment, this invention provides for methods of detecting and/or quantifying expression of hTRT mRNAs (including splicing or sequence variants and alternative alleles). In an alternative embodiment, the invention provides methods for detecting and analyzing normal or abnormal hTRT genes (or fragments thereof). The form of such qualitative or quantitative assays may include, but is not limited to, amplification-based assays with or without signal amplification, hybridization based assays, and combination amplification-hybridization assays. It will be appreciated by those of skill that the distinction between hybridization and amplification is for convenience only: as illustrated in the examples below, many assay formats involve elements of both hybridization and amplification, so that the categorization is somewhat arbitrary in some cases.

1) Preparation of Nucleic Acids

In some embodiments, nucleic acid assays are performed with a sample of nucleic acid isolated from the cell, tissue, organism, or cell line to be tested. The nucleic acid (e.g., genomic DNA, RNA or cDNA) may be "isolated" from the sample according to any of a number of methods well known to those of skill in the art. In this context, "isolated" refers to any separation of the species or target to be detected from any other substance in the mixture, but does not necessarily indicate a significant degree of purification of the target. One of skill will appreciate that, where alterations in the copy number of the hTRT gene are to be detected, genomic DNA is the target to be detected. Conversely, where expression levels of a gene or genes are to be detected, RNA is the target to be detected in a nucleic acid-based assay. In one preferred embodiment, the nucleic acid sample is the total mRNA (i.e., poly(A)$^+$ RNA) in a biological sample. Methods for isolating nucleic acids are well known to those of skill in the art and are described, for example, Tijssen, P. ed. of LABORATORY TECHNIQUES IN BIOCHEMISTRY AND MOLECULAR BIOLOGY: HYBRIDIZATION WITH NUCLEIC ACID PROBES, PART I. THEORY AND NUCLEIC ACID PREPARATION, Elsevier, N.Y. (1993) Chapt. 3, which is incorporated herein by reference. In one embodiment, the total nucleic acid is isolated from a given sample using an acid guanidinium-phenol-chloroform extraction method and poly(A)+ mRNA is isolated by oligo-dT column chromatography or by using (dT)n magnetic beads (see, e.g., Sambrook et al., and Ausubel et al., supra).

In alternative embodiments, it is not necessary to isolate nucleic acids (e.g., total or polyA$^+$ RNA) from the biological sample prior to carrying out amplification, hybridization or other assays. These embodiments have certain advantages when hTRT RNA is to be measured, because they reduce the possibility of loss of hTRT mRNA during isolation and handling. For example, many amplification techniques such as PCR and RT-PCR defined above can be carried out using permeabilized cells (histological specimens and FACS analyses), whole lysed cells, or crude cell fractions such as certain cell extracts. Preferably, steps are taken to preserve the integrity of the target nucleic acid (e.g., mRNA) if necessary (e.g., addition of RNAase inhibitors). Amplification and hybridization assays can also be carried out in situ, for example, in thin tissue sections from a biopsy sample or from a cell monolayer (e.g., blood cells or disaggregated tissue culture cells). Amplification can also be carried out in an intact whole cell or fixed cells. For example, PCR, RT-PCR, or LCR amplification methods may be carrier out, as is well known in the art, in situ, e.g., using a polymerase or ligase, a primer or primer(s), and (deoxy)ribonucleoside triphosphates (if a polymerase is employed), and reverse transcriptase and primer (if RNA is to be transcribed and the cDNA is to be detected) on fixed, permeabilized, or microinjected cells to amplify target hTRT RNA or DNA. Cells containing hTRT RNA (e.g., telomerase positive cells) or an hTRT DNA sequence of interest can then be detected. This method is often useful when fluorescently-labeled dNTPs, primers, or other components are used in conjunction with microscopy, FACS analysis or the equivalent.

2) Amplification Based Assays

In one embodiment, the assays of the present invention are amplification-based assays for detection of an hTRT gene or gene product. In an amplification based assay, all or part of an hTRT gene or transcript (e.g., mRNA or cDNA; hereinafter also referred to as "target") is amplified, and the amplification product is then detected directly or indirectly. When there is no underlying gene or gene product to act as a template, no amplification product is produced (e.g., of the expected size), or amplification is non-specific and typically there is no single amplification product. In contrast, when the underlying gene or gene product is present, the target sequence is amplified, providing an indication of the presence and/or quantity of the underlying gene or mRNA. Target amplification-based assays are well known to those of skill in the art.

The present invention provides a wide variety of primers and probes for detecting hTRT genes and gene products. Such primers and probes are sufficiently complementary to the hTRT gene or gene product to hybridize to the target nucleic acid. Primers are typically at least 6 bases in length, usually between about 10 and about 100 bases, typically between about 12 and about 50 bases, and often between about 14 and about 25 bases in length. One of skill, having reviewed the present disclosure, will be able, using routine methods, to select primers to amplify all, or any portion, of the hTRT gene or gene product, or to distinguish between variant gene products, hTRT alleles, and the like. Table 2 lists illustrative primers useful for PCR amplification of the hTRT, or specific hTRT gene products or regions. As is known in the art, single oligomers (e.g., U.S. Pat. No. 5,545,522), nested sets of oligomers, or even a degenerate pool of oligomers may be employed for amplification, e.g., as illustrated by the amplification of the *Tetrahymena* TRT cDNA as described infra.

The invention provides a variety of methods for amplifying and detecting an hTRT gene or gene product, including the polymerase chain reaction (including all variants, e.g., reverse-transcriptase-PCR; the Sunrise Amplification System (Oncor, Inc, Gaithersburg Md.); and numerous others known in the art). In one illustrative embodiment, PCR amplification is carried out in a 50 µl solution containing the nucleic acid sample (e.g., cDNA obtained through reverse transcription of hTRT RNA), 100 µM in each dNTP (dATP, dCTP, dGTP and dTTP; Pharmacia LKB Biotechnology, N.J.), the hTRT-specific PCR primer(s), 1 unit/Taq polymerase (Perkin Elmer, Norwalk Conn.), 1×PCR buffer (50 mM KCl, 10 mM Tris, pH 8.3 at room temperature, 1.5 mM $MgCl_2$, 0.01% gelatin) with the amplification run for about 30 cycles at 94° for 45 sec, 55° for 45 sec and 72° for 90 sec. However, as will be appreciated, numerous variations may be made to optimize the PCR amplification for any particular reaction.

Other suitable target amplification methods include the ligase chain reaction (LCR; e.g., Wu and Wallace, 1989, *Genomics* 4:560; Landegren et al., 1988, *Science*, 241: 1077, Barany, 1991, *Proc. Natl. Acad. Sci. USA* 88:189 and Barringer et al., 1990, *Gene,* 89: 117); strand displacement amplification (SDA; e.g., Walker et al., 1992, *Proc. Natl. Acad. Sci. U.S.A.* 89:392-396); transcription amplification (e.g., Kwoh et al., 1989, *Proc. Natl. Acad. Sci. USA,* 86: 1173); self-sustained sequence replication (3SR; e.g., Fahy et al., 1992, *PCR Methods Appl.* 1:25, Guatelli et al., 1990, *Proc. Nat. Acad. Sci. USA,* 87: 1874); the nucleic acid sequence based amplification (NASBA, Cangene, Mississauga, Ontario; e.g., Compton, 1991, *Nature* 350:91); the transcription-based amplification system (TAS); and the self-sustained sequence replication system (SSR). Each of the aforementioned publications is incorporated herein by reference. One useful variant of PCR is PCR ELISA (e.g., Boehringer Mannheim Cat. No. 1 636 111) in which digoxigenin-dUTP is incorporated into the PCR product. The PCR reaction mixture is denatured and hybridized with a biotin-labeled oligonucleotide designed to anneal to an internal sequence of the PCR product. The hybridization products are immobilized on streptavidin coated plates and detected using anti-digoxigenin antibodies. Examples of techniques sufficient to direct persons of skill through in vitro amplification methods are found in PCR Technology: Principles and Applications for DNA Amplification, H. Erlich, Ed. Freeman Press, New York, N.Y. (1992); PCR Protocols: A Guide to Methods and Applications, eds. Innis, Gelfland, Snisky, and White, Academic Press, San Diego, Calif. (1990); Mattila et al., 1991, *Nucleic Acids Res.* 19: 4967; Eckert and Kunkel, (1991) PCR Methods and Applications 1: 17; PCR, eds. McPherson, Quirkes, and Taylor, IRL Press, Oxford; U.S. Pat. Nos. 4,683,195, 4,683,202, and 4,965,188; Barringer et al., 1990, *Gene,* 89:117; Lomell et al., 1989, *J. Clin. Chem.,* 35:1826, each of which is incorporated herein for all purposes.

Amplified products may be directly analyzed, e.g., by size as determined by gel electrophoresis; by hybridization to a target nucleic acid immobilized on a solid support such as a bead, membrane, slide, or chip; by sequencing; immunologically, e.g., by PCR-ELISA, by detection of a fluorescent, phosphorescent, or radioactive signal; or by any of a variety of other well-known means. For example, an illustrative example of a detection method uses PCR primers augmented with hairpin loops linked to fluorescein and a benzoic acid derivative that serves as a quencher, such that fluorescence is emitted only when the primers unfold to bind their targets and replication occurs.

Because hTRT mRNA is typically expressed as an extremely rare transcript, present at very low levels even in telomerase positive cells, it is often desirable to optimize or increase the signal resulting from the amplification step. One way to do this is to increase the number of cycles of amplification. For example, although 20-25 cycles are adequate for amplification of most mRNAs using the polymerase chain reaction under standard reaction conditions, detection of hTRT mRNA in many samples can require as many as 30 to 35 cycles of amplification, depending on detection format and efficiency of amplification. It will be recognized that judicious choice of the amplification conditions including the number of amplification cycles can be used to design an assay that results in an amplification product only when there is a threshold amount of target in the test sample (i.e., so that only samples with a high level of hTRT mRNA give a "positive" result). In addition, methods are known to increase signal produced by amplification of the target sequence. Methods for augmenting the ability to detect the amplified target include signal amplification system such as: branched DNA signal amplification (e.g., U.S. Pat. No. 5,124,246; Urdea, 1994, *Bio/Tech.* 12:926); tyramide signal amplification (TSA) system (Du Pont); catalytic signal amplification (CSA; Dako); Q Beta Replicase systems (Tyagi et al., 1996, *Proc. Nat. Acad. Sci. USA,* 93: 5395); or the like.

One of skill in the art will appreciate that whatever amplification method is used, a variety of quantitative methods known in the art can be used if quantitation is desired. For example, when desired, two or more polynucleotides can be co-amplified in a single sample. This method can be used as a convenient method of quantitating the amount of hTRT mRNA in a sample, because the reverse transcription and amplification reactions are carried out in the same reaction for a target and control polynucleotide. The co-amplification of the control polynucleotide (usually present at a known concentration or copy number) can be used for normalization to the cell number in the sample as compared to the amount of hTRT in the sample. Suitable control polynucleotides for co-amplification reactions include DNA, RNA expressed from housekeeping genes, constitutively expressed genes, and in vitro synthesized RNAs or DNAs added to the reaction mixture. Endogenous control polynucleotides are those that are already present in the sample, while exogenous control polynucleotides are added to a sample, creating a "spiked" reaction. Illustrative control RNAs include β-actin RNA, GAPDH RNA, snRNAs, hTR, and endogenously expressed 28S rRNA (see Khan et al., 1992, *Neurosci. Lett.* 147:114). Exogenous control polynucleotides include a synthetic AW106 cRNA, which may be synthesized as a sense strand from pAW106 by T7 polymerase. It will be appreciated that for the co-amplification method to be useful for quantitation, the control and target polynucleotides must typically both be amplified in a linear range. Detailed protocols for quantitative PCR may be found in PCR PROTOCOLS, A GUIDE TO METHODS AND APPLICATIONS, Innis et al., Academic Press, Inc. N.Y., (1990) and Ausubel et al., supra (Unit 15) and Diaco, R. (1995) *Practical Considerations for the Design of Quantitative PCR Assays, in PCR* STRATEGIES, pg. 84-108, Innis et al. eds, Academic Press, New York.

Depending on the sequence of the endogenous or exogenous standard, different primer sets may be used for the co-amplification reaction. In one method, called competitive amplification, quantitative PCR involves simultaneously co-amplifying a known quantity of a control sequence using the same primers used for amplification of the target nucleic acid (one pair of 2 primers). In an alternative embodiment, known as non-competitive competition, the control sequence aid the target sequence (e.g., hTRT cDNA) are amplified using different primers (i.e., 2 pairs of 2 primers). In another alternative embodiment, called semi-competitive amplification, three primers are used, one of which is hTRT-specific, one of which is control specific, and one of which is capable of annealing to both the target and control sequences. Semi-competitive amplification is described in U.S. Pat. No. 5,629,154, which is incorporated herein by reference.

3) Hybridization-Based Assays a) GENERALLY

A variety of methods for specific DNA and RNA measurement using nucleic acid hybridization techniques are known to those of skill in the art (see Sambrook et al., supra). Hybridization based assays refer to assays in which a probe nucleic acid is hybridized to a target nucleic acid. Usually the nucleic acid hybridization probes of the invention are entirely or substantially identical to a contiguous sequence of the hTRT gene or RNA sequence. Preferably, nucleic acid probes are at least about 10 bases, often at least about 20 bases, and sometimes at least about 200 bases or more in length. Methods of selecting nucleic acid probe sequences for use in nucleic acid hybridization are discussed in Sambrook et al., supra. In some formats, at least one of the target and probe is immobilized. The immobilized nucleic acid may be DNA, RNA, or another oligo- or poly-nucleotide, and may comprise natural or non-naturally occurring nucleotides, nucleotide analogs, or backbones. Such assays may be in any of several formats including: Southern, Northern, dot and slot blots, high-density polynucleotide or oligonucleotide arrays (e.g., GeneChips™ Affymetrix), dip sticks, pins, chips, or beads. All of these techniques are well known in the art and are the basis of many commercially available diagnostic kits. Hybridization techniques are generally described in Hames et al., ed., NUCLEIC ACID HYBRIDIZATION, A PRACTICAL APPROACH IRL Press, (1985); Gall and Pardue *Proc. Natl. Acad. Sci., U.S.A.,* 63: 378-383 (1969); and John et al., *Nature,* 223: 582-587 (1969).

A variety of nucleic acid hybridization formats are known to those skilled in the art. For example, one common format is direct hybridization, in which a target nucleic acid is hybridized to a labeled, complementary probe. Typically, labeled nucleic acids are used for hybridization, with the label providing the detectable signal. One method for evaluating the presence, absence, or quantity of hTRT mRNA is carrying out a Northern transfer of RNA from a sample and hybridization of a labeled hTRT specific nucleic acid probe, as illustrated in Example 2. As was noted supra, hTRT mRNA, when present at all, is present in very low quantities in most cells. Therefore, when Northern hybridization is used, it will often be desirable to use an amplification step (or, alternatively, large amounts of starting RNA). A useful method for evaluating the presence, absence, or quantity of DNA encoding hTRT proteins in a sample involves a Southern transfer of DNA from a sample and hybridization of a labeled hTRT specific nucleic acid probe.

Other common hybridization formats include sandwich assays and competition or displacement assays. Sandwich assays are commercially useful hybridization assays for detecting or isolating nucleic acid sequences. Such assays utilize a "capture" nucleic acid covalently immobilized to a solid support and a labeled "signal" nucleic acid in solution. The biological or clinical sample will provide the target nucleic acid. The "capture" nucleic acid and "signal" nucleic acid probe hybridize with the target nucleic acid to form a "sandwich" hybridization complex. To be effective, the signal nucleic acid cannot hybridize with the capture nucleic acid.

b) Chip-Based and Slide-Based Assays

The present invention also provides probe-based hybridization assays for hTRT gene products employing arrays of immobilized oligonucleotide or polynucleotides to which an hTRT nucleic acid can hybridize (i.e., to some, but usually not all or even most, of the immobilized oligo- or polynucleotides). High density oligonucleotide arrays or polynucleotide arrays provide a means for efficiently detecting the presence and characteristics (e.g., sequence) of a target nucleic acid (e.g., hTRT gene, mRNA, or cDNA). Techniques are known for producing arrays containing thousands of oligonucleotides complementary to defined sequences, at defined locations on a surface using photolithographic techniques for synthesis in situ (see, e.g., U.S. Pat. Nos. 5,578, 832; 5,556,752; and 5,510,270; Fodor et al., 1991, *Science* 251:767; Pease et al., 1994, *Proc. Natl. Acad. Sci. USA* 91:5022; and Lockhart et al., 1996, *Nature Biotech* 14:1675) or other methods for rapid synthesis and deposition of defined oligonucleotides (Blanchard et al., 1996, *Biosensors & Bioelectronics* 11:687). When these methods are used, oligonucleotides (e.g., 20-mers) of known sequence are synthesized directly on a surface such as a derivatized glass slide. Usually, the array produced is redundant, having several oligonucleotide probes on the chip specific for the hTRT polynucleotide to be detected.

Combinations of oligonucleotide probes can be designed to detect alternatively spliced mRNAs, or to identify which of various hTRT alleles is expressed in a particular sample.

In one illustrative embodiment, cDNA prepared by reverse transcription of total RNA from a test cell is amplified (e.g., using PCR). Typically the amplification product is labeled, e.g., by incorporation of a fluorescently labeled dNTP. The labeled cDNAs are then hybridized to a chip comprising oligonucleotide probes complementary to various subsequences of the hTRT gene. The positions of hybridization are determined (e.g., in accordance with the general methods of Shalon et al., 1996, Genome Research 6:639 or Schena et al., 1996, Genome Res. 6:639), and sequence (or other information) deduced from the hybridization pattern, by means well known in the art.

In one embodiment, two cDNA samples, each labeled with a different fluorescent group, are hybridized to the same chip. The ratio of the hybridization of each labeled sample to sites complementary to the hTRT gene are then assayed. If both samples contain the same amount of hTRT mRNA, the ratio of the two fluors will be 1:1 (it will be appreciated that the signal from the fluors may need to be adjusted to account for any difference in the molar sensitivity of the fluors). In contrast, if one sample is from a healthy (or control) tissue and the second sample is from a cancerous tissue the fluor used in the second sample will predominate.

c) In Situ Hybridization

An alternative means for detecting expression of a gene encoding an hTRT protein is in situ hybridization. In situ hybridization assays are well known and are generally described in Angerer et al., METHODS ENZYMOL., 152: 649-660 (1987) and Ausubel et al., supra. In an in situ hybridization assay, cells or tissue specimens are fixed to a solid support, typically in a permeablilized state, typically on a glass slide. The cells are then contacted with a hybridization solution at a moderate temperature to permit annealing of labeled nucleic acid probes (e.g., $^{35}$S-labeled riboprobes, fluorescently labeled probes) completely or substantially complementary to hTRT. Free probe is removed by washing and/or nuclease digestion, and bound probe is visualized directly on the slide by autoradiography or an appropriate imaging techniques, as is known in the art.

4) Specific Detection of Variants

As noted supra and illustrated in the Examples (e.g., Example 9), amplification primers or probes can be selected to provide amplification products that span specific deletions, truncations, and insertions, thereby facilitating the detection of specific variants or abnormalities in the hTRT mRNA.

One example of an hTRT variant gene product that may be detected is an hTRT RNA such as a product (SEQ ID NO:4) described supra and in Example 9. The biological function, if any, of the Δ182 variant(s) is not known; however, the truncated hTRT protein putatively encoded by the variant may be involved in regulation of telomerase activity, e.g., by assembling a non-functional telomerase RNP that titrates telomerase components. Alternatively, negative regulation of telomerase activity could be accomplished by directing hTRT pre-mRNA (nascent mRNA) processing in a manner leading to elimination of the full length mRNA and reducing hTRT mRNA levels and increasing Δ182 hTRT RNA levels. For these and other reasons, the ability to detect Δ182 variants is useful. In addition, it will sometimes be desirable, in samples in which two species of hTRT RNA are present (such as a Δ182 hTRT RNA and hTRT RNA encoding the full-length hTRT protein) to compare their relative and/or absolute abundance.

The invention provides a variety of methods for detection of Δ182 variants. For example, amplification using primer pairs spanning the 182 basepair deletion will result in different sized products corresponding to the deleted and undeleted hTRT RNAs, if both are present, which can be distinguished on the basis of size (e.g., by gel electrophoresis). Examples of primer pairs useful for amplifying the region spanning the 182 bp deletion include TCP1.14 and TCP1.15 (primer set 1), or TCP1.25 and billTCP6 (primer set 2) (see Table 2). These primer pairs can be used individually or in a nested PCR experiment where primer set 1 is used first. It will also be apparent to one of skill that hybridization methods (e.g., Northern hybridization) or RNAse protection assays using an hTRT nucleic acid probe of the invention can be used to detect and distinguish hTRT RNA variants.

Another suitable method entails PCR amplification (or the equivalent) using three primers. Analogous to the semi-competitive quantitative PCR method described in greater detail supra, one primer is specific to each of the hTRT RNA species (e.g., as illustrated in Table 4) and one primer is complementary to both species (e.g., TCP1.25 (2270-2288)). An example of a primer specific to SEQ ID NO:1 is one that anneals within the 182 nucleotide sequence (i.e., nucleotides 2345 to 2526 of SEQ ID NO:1), e.g., TCP1.73 (2465-2445). For example, a primer specific to SEQ ID NO:4 (a Δ182 variant) is one that anneals at nucleotides 2358 to 2339 of SEQ ID NO:4 (i.e., the site corresponding to the 182 nucleotide insertion in SEQ ID NO:1). The absolute abundance of the Δ182 hTRT mRNA species or its relative abundance compared to the species encoding the full-length hTRT protein can be analyzed for correlation to cell state (e.g., capacity for indefinite proliferation). It will be appreciated that numerous other primers or amplification or detection methods can be selected based on the present disclosure.

TABLE 4

ILLUSTRATIVE PRIMERS

Δ182 species (e.g., SEQ ID NO:4) specific primer:
5'-GGCACTGGACGTAGGACGTG-3  (SEQ ID NO:550)
hTRT (SEQ ID NO:1) specific primer (TCP1.73):
5'-CACTGCTGGCCTCATTCAGGG-3  (SEQ ID NO:445)
Common (forward) primer (TCP1.25):
5'-TACTGCGTGCGTCGGTATG-3'  (SEQ ID NO:399)

Other variant hTRT genes or gene products that can be detected include those characterized by premature stop codons, deletions, substitutions or insertions. Deletions can be detected by the decreased size of the gene, mRNA transcript, or cDNA. Similarly, insertions can be detected by the increased size of the gene, mRNA transcript, or cDNA insertions and deletions could also cause shifts in the reading frame that lead to premature stop codons or longer open reading frames. Substitutions, deletions, and insertions can also be detected by probe hybridization. Alterations can also be detected by observing changes in the size of the variant hTRT polypeptide (e.g., by Western analysis) or by hybridization or specific amplification as appropriate. Alternatively, mutations can be determined by sequencing of the gene or gene product according to standard methods. In addition, and as noted above, amplification assays and hybridization probes can be selected to target particular abnormalities specifically. For example, nucleic acid probes or amplification primers can be selected that specifically hybridize to or amplify, respectively, the region encompassing the deletion, substitution, or insertion. Where the hTRT gene harbors such a mutation, the probe will either (1) fail to hybridize or the amplification reaction will fail to provide specific amplification or cause a change in the size of the amplification product or hybridization signal; or (2) the probe or amplification reaction encompasses the entire deletion or either end of the deletion (deletion junction); or (3) similarly, probes and amplification primers can be selected that specifically target point mutations or insertions.

5) Detection of Mutant hTRT Alleles

Mutations in the hTRT gene can be responsible for disease initiation or can contribute to a disease condition. Alterations of the genomic DNA of hTRT can affect levels of gene transcription, change amino acid residues in the hTRT protein, cause truncated hTRT polypeptides to be produced, alter pre-mRNA processing pathways (which can alter hTRT mRNA levels), and cause other consequences as well.

Alterations of genomic DNA in non-hTRT loci can also affect expression of hTRT or telomerase by altering the enzymes or cellular processes that are responsible for regulating hTRT, hTR, and telomerase-associated protein expression and processing and RNP assembly and transport. Alterations which affect hTRT expression, processing, or RNP assembly could be important for cancer progression, for diseases of aging, for DNA damage diseases, and others.

Detection of mutations in hTRT mRNA or its gene and gene control elements can be accomplished in accordance with the methods herein in multiple ways. Illustrative examples include the following: A technique termed primer screening can be employed; PCR primers are designed whose 3'termini anneal to nucleotides in a sample DNA (or RNA) that are possibly mutated. If the DNA (or RNA) is amplified by the primers, then the 3' termini matched the nucleotides in the gene; if the DNA is not amplified, then one or both termini did not match the nucleotides in the gene, indicating a mutation was present. Similar primer design can be used to assay for point mutations using the Ligase Chain Reaction (LCR, described supra). Restriction fragment length polymorphism, RFLP (Pourzand, C., Cerutti, P (1993) Mutat. Res 288: 113-121), is another technique that can be applied in the present method. A Southern blot of human genomic DNA digested with various restriction enzymes is probed with an hTRT specific probe. Differences in the fragment number or sizes between the sample and a control indicate an alteration of the experimental sample, usually an insertion or deletion. Single strand conformation polymorphism, SSCP (Orrita, M., et al. (1989) PNAS USA 86:2766-70), is another technique that can be applied in the present method. SSCP is based on the differential migration of denatured wild-type and mutant single-stranded DNA (usually generated by PCR). Single-stranded DNA will take on a three-dimensional conformation that is sequence-specific. Sequence differences as small as a single base change can result in a mobility shift on a nondenaturing gel. SSCP is one of the most widely used mutation screening methods because of its simplicity. Denaturing Gradient Gel Electrophoresis, DGGE (Myers, R. M., Maniatis, T. and Lerman, L., (1987) Methods in Enzymology, 155: 501-527), is another technique that can be applied in the present method. DGGE identifies mutations based on the melting behavior of double-stranded DNA. Specialized denaturing electrophoresis equipment is utilized to observe the melting profile of experimental and control DNAs: a DNA containing a mutation will have a different mobility compared to the control in these gel systems. The examples discussed illustrate commonly employed methodology; many other techniques exist which are known by those skilled in the art and can be applied in accordance with the teachings herein.

F. Karyotype Analysis

The present invention further provides methods and reagents for karyotype or other chromosomal analysis using hTRT-sequence probes and/or detecting or locating hTRT gene sequences in chromosomes from a human patient, human cell line, or non-human cell. In one embodiment, amplification (i.e., change in copy number), deletion (i.e., partial deletion), insertion, substitution, or changes in the chromosomal location (e.g., translocation) of an hTRT gene may be correlated with the presence of a pathological condition or a predisposition to developing a pathological condition (e.g., cancer).

Figure 8:
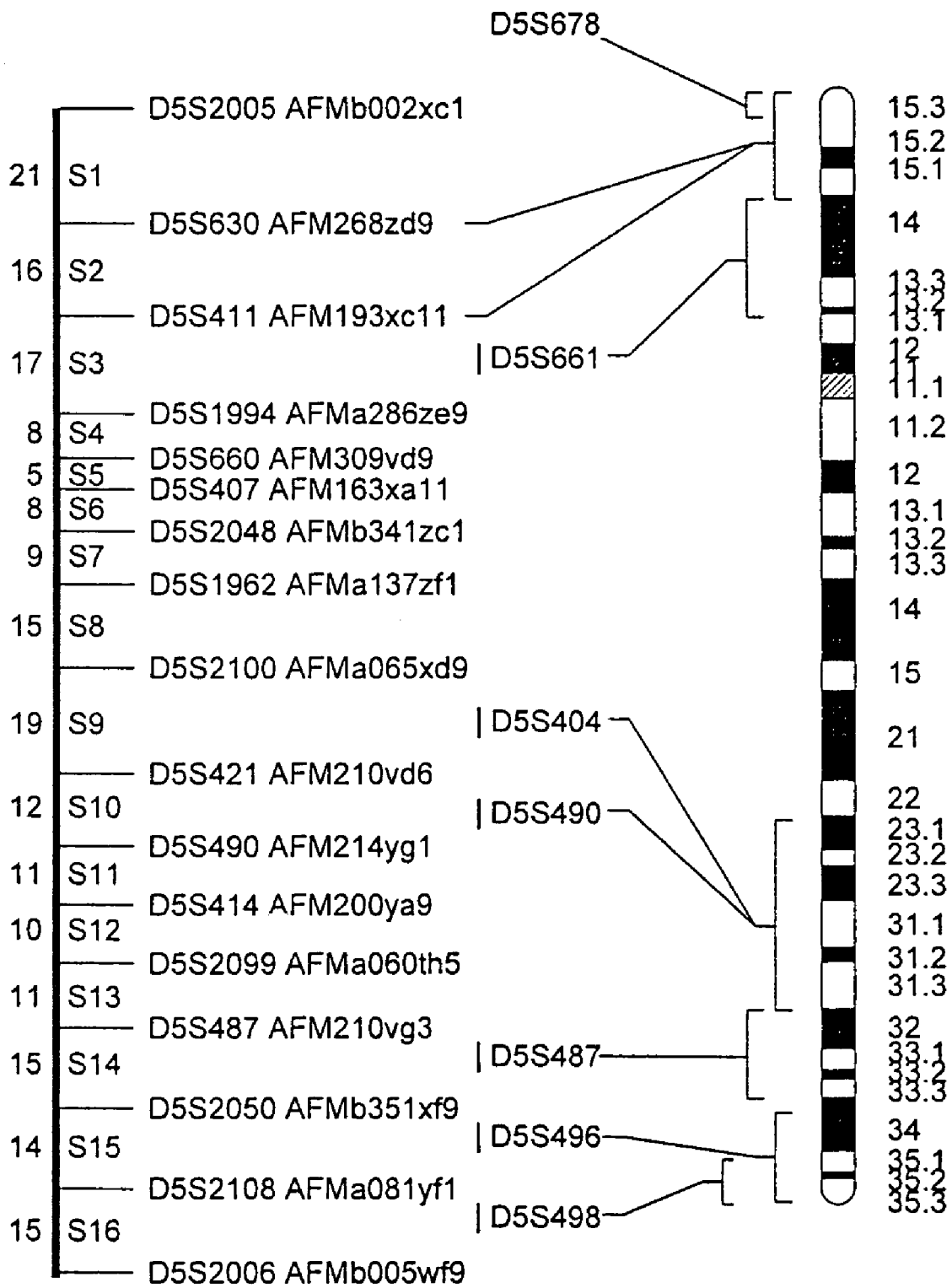
FIG. 8 shows a map of chromosome 5p with the location of the STS marker D5S678 (located near the hTRT gene) indicated.

It has been determined by the present inventors that, in normal human cells, the hTRT gene maps close to the telomere of chromosome 5p (see Example 5, infra). The closest STS marker is D5S678 (see FIG. 8). The location can be used to identify markers that are closely linked to the hTRT gene. The markers can be used to identify YACs, STSs, cosmids, BACs, lambda or P1 phage, or other clones which contain hTRT genomic sequences or control elements. The markers or the gene location can be used to scan human tissue samples for alterations in the normal hTRT gene location, organization or sequence that is associated with the occurrence of a type of cancer or disease. This information can be used in a diagnostic or prognostic manner for the disease or cancer involved. Moreover, the nature of any alterations to the hTRT gene can be informative as to the nature by which cells become immortal. For instance, a translocation event could indicate that activation of hTRT expression occurs in some cases by replacing the hTRT promoter with another promoter which directs hTRT transcription in an inappropriate manner. Methods and reagents of the invention of this type can be used to inhibit hTRT activation. The location may also be useful for determining the nature of hTRT gene repression in normal somatic cells, for instance, whether the location is part of non-expressing heterochromatin. Nuclease hypersensitivity assays for distinguishing heterochromatin and euchromatin are described, for example, in Wu et al., 1979, Cell 16:797; Groudine and Weintraub, 1982, Cell 30:131 Gross and Garrard, 1988, Ann. Rev. Biochem. 57:159.

In one embodiment, alterations to the hTRT gene are identified by karyotype analysis, using any of a variety of methods known in the art. One useful technique is in situ hybridization (ISH). Typically, when in situ hybridization techniques are used for karyotype analysis, a detectable or detectably-labeled probe is hybridized to a chromosomal sample in situ to locate an hTRT gene sequence. Generally, ISH comprises one or more of the following steps: (1) fixation of the tissue, cell or other biological structure to be analyzed; (2) prehybridization treatment of the biological structure to increase accessibility of target DNA (e.g., denaturation with heat or alkali), and to reduce nonspecific binding (e.g., by blocking the hybridization capacity of repetitive sequences, e.g., using human genomic DNA); (3) hybridization of one or more nucleic acid probes (e.g., conventional nucleic acids, PNAs, or probes containing other nucleic acid analogs) to the nucleic acid in the biological structure or tissue; (4) posthybridization washes to remove nucleic acid fragments not bound in the hybridization; and, (5) detection of the hybridized nucleic acid fragments. The reagents used in each of these steps and conditions for their use vary depending on the particular application. It will be appreciated that these steps can be modified in a variety of ways well known to those of skill in the art.

In one embodiment of ISH, the hTRT probe is labeled with a fluorescent label (fluorescent in situ hybridization; "FISH"). Typically, it is desirable to use dual color fluorescent in situ hybridization, in which two probes are utilized, each labeled by a different fluorescent dye. A test probe that hybridizes to the hTRT sequence of interest is labeled with one dye, and a control probe that hybridizes to a different region is labeled with a second dye. A nucleic acid that hybridizes to a stable portion of the chromosome of interest, such as the centromere region, can be used as the control probe. In this way, one can account for differences between efficiency of hybridization from sample to sample.

The ISH methods for detecting chromosomal abnormalities (e.g., FISH) can be performed on nanogram quantities of the subject nucleic acids. Paraffin embedded normal tissue or tumor sections can be used, as can fresh or frozen material, tissues, or sections. Because FISH can be applied to limited material, touch preparations prepared from uncultured primary tumors can also be used (see, e.g., Kallioniemi et al., 1992, *Cytogenet. Cell Genet.* 60:190). For instance, small biopsy tissue samples from tumors can be used for touch preparations (see, e.g., Kallioniemi et al., supra). Small numbers of cells obtained from aspiration biopsy or cells in bodily fluids (e.g., blood, urine, sputum and the like) can also be analyzed. For prenatal diagnosis, appropriate samples will include amniotic fluid, maternal blood, and the like. Useful hybridization protocols applicable to the methods and reagents disclosed here are described in Pinkel et al., 1988, *Proc. Natl. Acad. Sci. USA,* 85:9138; EPO Pub. No. 430,402; Choo, ed., METHODS IN MOLECULAR BIOLOGY VOL. 33: IN SITU HYBRIDIZATION PROTOCOLS, Humana Press, Totowa, N.J., (1994); and Kallioniemi et al., supra.

Other techniques useful for karyotype analysis include, for example, techniques such as quantitative Southern blotting, quantitative PCR, or comparative genomic hybridization (Kallioniemi et al., 1992, *Science,* 258:818), using the hTRT probes and primers of the invention which may be used to identify amplification, deletion, insertion, substitution or other rearrangement of hTRT sequences in chromosomes in a biological sample.

G. TRT Polypeptide Assays

1) Generally

The present invention provides methods and reagents for detecting and quantitating hTRT polypeptides. These methods include analytical biochemical methods such as electrophoresis, mass spectroscopy, gel shift, capillary electrophoresis, chromatographic methods such as size exclusion chromatography, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, western blotting, mass spectrometry, and others described below and apparent to those of skill in the art upon review of this disclosure.

2) Electrophoretic Assays

In one embodiment, the hTRT polypeptides are detected in an electrophoretic protein separation; in one aspect, a two-dimensional electrophoresis system is employed. Means of detecting proteins using electrophoretic techniques are well known to those of skill in the art (see generally, R. Scopes (1982) PROTEIN PURIFICATION, Springer-Verlag, N.Y.; Deutscher, (1990) METHODS IN ENZYMOLOGY VOL. 182: GUIDE TO PROTEIN PURIFICATION, Academic Press, Inc., N.Y.).

In a related embodiment, a mobility shift assay (see, e.g., Ausubel et al., supra) is used. For example, labeled-hTR will associate with hTRT and migrate with altered mobility upon electrophoresis in a nondenaturing polyacrylamide gel or the like. Thus, for example, if an (optionally labeled) hTR probe or a (optionally labeled) telomerase primer is mixed with a sample containing hTRT, or coexpressed with hTRT (e.g., in a cell-free expression system) the presence of hTRT protein (or a polynucleotide encoding hTRT) in the sample will result in a detectable alteration of hTR mobility.

3) Immunoassays a) GENERALLY

The present invention also provides methods for detection of hTRT polypeptides employing one or more antibody reagents of the invention (i.e., immunoassays). As used herein, an immunoassay is an assay that utilizes an antibody (as broadly defined herein and specifically includes fragments, chimeras and other binding agents) that specifically binds an hTRT polypeptide or epitope. Antibodies of the invention may be made by a variety of means well known to those of skill in the art, e.g., as described supra.

A number of well established immunological binding assay formats suitable for the practice of the invention are known (see, e.g., U.S. Pat. No. 4,366,241; 4,376,110; 4,517, 288; and 4,837,168). See, e.g., METHODS IN CELL BIOLOGY VOLUME 37: ANTIBODIES IN CELL BIOLOGY, Asai, ed. Academic Press, Inc. New York (1993); BASIC AND CLINICAL IMMUNOLOGY 7th Edition, Stites & Terr, eds. (1991); Harlow and Lane, supra [e.g., Chapter 14], and Ausubel et al., supra, [e.g., Chapter 11], each of which is incorporated by reference in its entirety and for all purposes. Typically, immunological binding assays (or immunoassays) utilize a "capture agent" to specifically bind to and, often, immobilize the analyte. In one embodiment, the capture agent is a moiety that specifically binds to an hTRT polypeptide or subsequence, such as an anti-hTRT antibody. In an alternative embodiment, the capture agent may bind an hTRT-associated protein or RNA under conditions in which the hTRT-associated molecule remains bound to the hTRT (such that if the hTRT-associated molecule is immobilized the hTRT protein is similarly immobilized). It will be understood that in assays in which an hTRT-associated molecule is captured the associated hTRT protein will usually be present and so can be detected, e.g., using an anti-hTRT antibody or the like. Immunoassays for detecting protein complexes are known in the art (see, e.g., Harlow and Lane, supra, at page 583).

Usually the hTRT gene product being assayed is detected directly or indirectly using a detectable label. The particular label or detectable group used in the assay is usually not a critical aspect of the invention, so long as it does not significantly interfere with the specific binding of the antibody or antibodies used in the assay. The label may be covalently attached to the capture agent (e.g., an anti-TRT antibody), or may be attached to a third moiety, such as another antibody, that specifically binds to, e.g.,: the hTRT polypeptide (at a different epitope than recognized by the capture agent), the capture agent (e.g., an anti-(first antibody) immunoglobulin); an anti-TRT antibody; an antibody that binds an anti-TRT antibody; or, an antibody/telomerase complex (e.g., via binding to an associated molecule such as a telomerase-associated protein). Other proteins capable of binding an antibody used in the assay, such as protein A or protein G, may also be labeled. In some embodiments, it will be useful to use more than one labeled molecule (i.e., ones that can be distinguished from one another). In addition, when the target bound (e.g., immobilized) by the capture agent (e.g., anti-hTRT antibody) is a complex (i.e., a complex of hTRT and a TRT-associated protein, hTR, or other TRT associated molecule), a labeled antibody that recognizes the protein or RNA associated with the hTRT protein can be used. When the complex is a protein-nucleic acid complex (e.g., TRT-hTR), the reporter molecule can be a polynucleotide or other molecule (e.g., enzyme) that recognizes the RNA component of the complex.

Some immunoassay formats do not require the use of labeled components. For instance, agglutination assays can be used to detect the presence of the target antibodies. In this case, antigen-coated particles are agglutinated by samples comprising the target antibodies. In this format, the components do not need to be labeled, and the presence of the target antibody can be detected by simple visual inspection.

b) Non-Competitive Assay Formats

The present invention provides methods and reagents for competitive and noncompetitive immunoassays for detecting hTRT polypeptides. Noncompetitive immunoassays are assays in which the amount of captured analyte (in this case hTRT) is directly measured. One such assay is a two-site, monoclonal-based immunoassay utilizing monoclonal antibodies reactive to two non-interfering epitopes on the hTRT protein. See, e.g., Maddox et al., 1983, *J. Exp. Med.*, 158:1211 for background information. In one preferred "sandwich" assay, the capture agent (e.g., an anti-TRT antibody) is bound directly to a solid substrate where it is immobilized. These immobilized antibodies then capture any hTRT protein present in the test sample. The hTRT thus immobilized can then be labeled, i.e., by binding to a second anti-hTRT antibody bearing a label. Alternatively, the second anti-hTRT antibody may lack a label, but be bound by a labeled third antibody specific to antibodies of the species from which the second antibody is derived. The second antibody alternatively can be modified with a detectable moiety, such as biotin, to which a third labeled molecule can specifically bind, such as enzyme-labeled streptavidin.

c) Competitive Assay Formats

In competitive assays, the amount of hTRT protein present in the sample is measured indirectly by measuring the amount of an added (exogenous) hTRT displaced (or competed away) from a capture agent (e.g., anti-TRT antibody) by the hTRT protein present in the sample. In one competitive assay, a known amount of labeled hTRT protein is added to the sample and the sample is then contacted with a capture agent (e.g., an antibody that specifically binds hTRT protein). The amount of exogenous (labeled) hTRT protein bound to the antibody is inversely proportional to the concentration of hTRT protein present in the sample. In one embodiment, the antibody is immobilized on a solid substrate. The amount of hTRT protein bound to the antibody may be determined either by measuring the amount of hTRT protein present in a TRT/antibody complex, or alternatively by measuring the amount of remaining uncomplexed TRT protein. The amount of hTRT protein may be detected by providing a labeled hTRT molecule.

A hapten inhibition assay is another example of a competitive assay. In this assay hTRT protein is immobilized on a solid substrate. A known amount of anti-TRT antibody is added to the sample, and the sample is then contacted with the immobilized hTRT protein. In this case, the amount of anti-TRT antibody bound to the immobilized hTRT protein is inversely proportional to the amount of hTRT protein present in the sample. The amount of immobilized antibody may be detected by detecting either the immobilized fraction of antibody or the fraction of the antibody that remains in solution. In this aspect, detection may be direct, where the antibody is labeled, or indirect where the label is bound to a molecule that specifically binds to the antibody as described above.

d) Other Assay Formats

The invention also provides reagents and methods for detecting and quantifying the presence of hTRT in the sample by using an immunoblot (Western blot) format. In this format, hTRT polypeptides in a sample are separated from other sample components by gel electrophoresis (e.g., on the basis of molecular weight), the separated proteins are transferred to a suitable solid support (such as a nitrocellulose filter, a nylon filter, derivatized nylon filter, or the like), and the support is incubated with anti-TRT antibodies of the invention. The anti-TRT antibodies specifically bind to hTRT or other TRT on the solid support. These antibodies may be directly labeled or alternatively may be subsequently detected using labeled antibodies (e.g., labeled sheep anti-mouse antibodies) or other labeling reagents that specifically bind to the anti-TRT antibody.

Other assay formats include liposome immunoassays (LIA), which use liposomes designed to bind specific molecules (e.g., antibodies) and release encapsulated reagents or markers. The released chemicals can then be detected according to standard techniques (see, Monroe et al., 1986, *Amer. Clin. Prod. Rev.* 5:34).

As noted supra, assay formats using FACS (and equivalent instruments or methods) have advantages when measuring hTRT gene products in a heterogeneous sample (such as a biopsy sample containing both normal and malignant cells).

e) Substrates, Solid Supports, Membranes, Filters

As noted supra, depending upon the assay, various components, including the antigen, target antibody, or anti-hTRT antibody, may be bound to a solid surface or support (i.e., a substrate, membrane, or filter paper). Many methods for immobilizing biomolecules to a variety of solid surfaces are known in the art. For instance, the solid surface may be a membrane (e.g., nitrocellulose), a microtiter dish (e.g., PVC, polypropylene, or polystyrene), a test tube (glass or plastic), a dipstick (e.g. glass, PVC, polypropylene, polystyrene, latex, and the like), a microcentrifuge tube, or a glass or plastic bead. The desired component may be covalently bound or noncovalently attached through nonspecific bonding.

A wide variety of organic and inorganic polymers, both natural and synthetic may be employed as the material for the solid surface. Illustrative polymers include polyethylene, polypropylene, poly(4-methylbutene), polystyrene, polymethacrylate, poly(ethylene terephthalate), rayon, nylon, poly(vinyl butyrate), polyvinylidene difluoride (PVDF), silicones, polyformaldehyde, cellulose, cellulose acetate, nitrocellulose, and the like. Other materials which may be employed, include paper, glasses, ceramics, metals, metalloids, semiconductive materials, cements or the like. In addition, substances that form gels, such as proteins (e.g., gelatins), lipopolysaccharides, silicates, agarose and polyacrylamides can be used. Polymers which form several aqueous phases, such as dextrans, polyalkylene glycols or surfactants, such as phospholipids, long chain (12-24 carbon atoms) alkyl ammonium salts and the like are also suitable. Where the solid surface is porous, various pore sizes may be employed depending upon the nature of the system.

In preparing the surface, a plurality of different materials may be employed, particularly as laminates, to obtain various properties. For example, protein coatings, such as gelatin can be used to avoid non-specific binding, simplify covalent conjugation, enhance signal detection or the like.

If covalent bonding between a compound and the surface is desired, the surface will usually be polyfunctional or be capable of being polyfunctionalized. Functional groups which may be present on the surface and used for linking can include carboxylic acids, aldehydes, amino groups, cyano groups, ethylenic groups, hydroxyl groups, mercapto groups and the like. The manner of linking a wide variety of compounds to various surfaces is well known and is amply illustrated in the literature. See, for example, *Immobilized Enzymes*, Ichiro Chibata, Halsted Press, New York, 1978, and Cuatrecasas (1970) *J. Biol. Chem.* 245 3059).

In addition to covalent bonding, various methods for noncovalently binding an assay component can be used. Noncovalent binding is typically nonspecific absorption of a compound to the surface.

One of skill in the art will appreciate that it is often desirable to reduce non-specific binding in immunoassays. Particularly, where the assay involves an antigen or antibody immobilized on a solid substrate it is desirable to minimize the amount of non-specific binding to the substrate. Means of reducing such non-specific binding are well known to those of skill in the art. Typically, this involves coating the substrate with a proteinaceous composition. In particular, protein compositions such as bovine serum albumin (BSA), nonfat powdered milk, and gelatin are widely used with powdered milk sometimes preferred. Alternatively, the surface is designed such that it nonspecifically binds one component but does not significantly bind another. For example, a surface bearing a lectin such as Concanavalin A will bind a carbohydrate containing compound but not a labeled protein that lacks glycosylation. Various solid surfaces for use in noncovalent attachment of assay components are reviewed in U.S. Pat. Nos. 4,447,576 and 4,254,082.

H) Assays for Anti-TRT Antibodies

The present invention also provides reagents and assays for detecting hTRT-specific immunoglobulins. In one embodiment, immobilized hTRT (e.g., recombinant hTRT bound to a microassay plate well) is incubated with serum from a patient under conditions in which anti-hTRT antibodies, if present, bind the immobilized hTRT. After washing to remove nonspecifically bound immunoglobulin, bound serum antibodies can be detected, if they are present, by adding detectably labeled anti-(human Ig) antibodies (alternative embodiments and variations are well known to those of skill in the art; see, e.g., Harlow, supra, at Ch. 14). These assays are useful for detecting anti-hTRT antibodies in any source including animal or human serum or a carrier such as saline. In one embodiment, the assays are used to detect or monitor an immune response to hTRT proteins in a patient, particularly an autoimmune (e.g., anti-telomerase) response. Anti-hTRT antibodies may be present in the serum or other tissues or fluids from a patient suffering from an autoimmune disease or other condition.

I) Assay Combinations

The diagnostic and prognostic assays described herein can be carried out in various combinations and can also be carried out in conjunction with other diagnostic or prognostic tests. For example, when the present methods are used to detect the presence of cancer cells in patient sample, the presence of hTRT can be used to determine the stage of the disease, whether a particular tumor is likely to invade adjoining tissue or metastasize to a distant location, and whether a recurrence of the cancer is likely. Tests that may provide additional information include microscopic analysis of biopsy samples, detection of antigens (e.g., cell-surface markers) associated with tumorigenicity (e.g., using histocytochemistry, FACS, or the like), imaging methods (e.g., upon administration to a patient of labeled anti-tumor antibodies), telomerase activity assays, telomere length assays, hTR assays, or the like. Such combination tests can provide useful information regarding the progression of a disease.

It will also be recognized that combinations of assays can provide useful information. For example, and as noted above, assays for hTRT mRNA can be combined with assays for hTR (human telomerase RNA) or telomerase activity (i.e., TRAP) assays to provide information about telomerase assembly and function.

J) Kits

The present invention also provides kits useful for the screening, monitoring, diagnosis and prognosis of patients with a telomerase-related condition, or for determination of the level of expression of hTRT in cells or cell lines. The kits include one or more reagents for determining the presence or absence of an hTRT gene product (RNA or protein) or for quantifying expression of the hTRT gene. Preferred reagents include nucleic acid primers and probes that specifically bind to the hTRT gene, RNA, cDNA, or portions thereof, along with proteins, peptides, antibodies, and control primers, probes, oligonucleotides, proteins, peptides and antibodies. Other materials, including enzymes (e.g., reverse transcriptases, DNA polymerases, ligases), buffers, reagents (labels, dNTPs), may be included.

The kits may include alternatively, or in combination with any of the other components described herein, an antibody that specifically binds to hTRT polypeptides or subsequences thereof. The antibody can be monoclonal or polyclonal. The antibody can be conjugated to another moiety such as a label and/or it can be immobilized on a solid support (substrate). The kit(s) may also contain a second antibody for detection of hTRT polypeptide/antibody complexes or for detection of hybridized nucleic acid probes, as well as one or more hTRT peptides or proteins for use as control or other reagents.

The antibody or hybridization probe may be free or immobilized on a solid support such as a test tube, a microtiter plate, a dipstick and the like. The kit may also contain instructional materials teaching the use of the antibody or hybridization probe in an assay for the detection of TRT. The kit may contain appropriate reagents for detection of labels, or for labeling positive and negative controls, washing solutions, dilution buffers and the like.

In one embodiment, the kit includes a primer pair for amplifying hTRT mRNA. Such a kit may also include a probe for hTRT amplified DNA and/or a polymerase, buffer, dNTPs, and the like. In another, the kit comprises a probe, optionally a labeled probe. In another, the kit comprises an antibody.

X. IDENTIFICATION OF MODULATORS OF TELOMERASE ACTIVITY

A. Generally

The invention provides compounds and treatments that modulate the activity or expression of a telomerase or telomerase component (e.g., hTRT protein). The invention also provides assays and screening methods (including high-throughput screens) for identification of compounds and treatments that modulate telomerase activity or expression. These modulators of telomerase activity and expression (hereinafter referred to as "modulators") include telomerase agonists (which increase telomerase activity and/or expression) and telomerase antagonists (which decrease telomerase activity and/or expression).

The modulators of the invention have a wide variety of uses. For example, it is contemplated that telomerase modulators will be effective therapeutic agents for treatment of human diseases. Screening for agonist activity and transcriptional or translational activators provides for compositions that increase telomerase activity in a cell (including a telomere dependent replicative capacity, or a "partial" telomerase activity). Such agonist compositions provide for methods of immortalizing otherwise normal untransformed cells, including cells which can express useful proteins. Such agonists can also provide for methods of controlling cellular senescence. Conversely, screening for antagonist activity provides for compositions that decrease telomere dependent replicative capacity, thereby mortalizing otherwise immortal cells, such as cancer cells. Screening for antagonist activity provides for compositions that decrease telomerase activity, thereby preventing unlimited cell division of cells exhibiting unregulated cell growth, such as cancer cells. Illustrative diseases and conditions that may be treated using modulators are listed herein, e.g., in Sections VIII and IX, supra. In general, the modulators of the invention can be used whenever it is desired to increase or decrease a telomerase activity in a cell or organism. Thus, in addition to use in treatment of disease, a modulator that increases hTRT expression levels can be used to produce a cultured human cell line having properties as generally described in Section VIII, supra, and various other uses that will be apparent to one of skill.

A compound or treatment modulates "expression" of telomerase or a telomerase component when administration of the compound or treatment changes the rate or level of transcription of the gene encoding a telomerase component (e.g., the gene encoding hTRT mRNA), affects stability or post-transcriptional processing of RNA encoding a telomerase component (e.g., transport, splicing, polyadenylation, or other modification), affects translation, stability, post-translational processing or modification of an encoded protein (e.g., hTRT), or otherwise changes the level of functional (e.g., catalytically active) telomerase RNP. A compound or treatment affects a telomerase "activity" when administration of the compound or treatment changes a telomerase activity such as any activity described in Section IV(B), supra (e.g., including processive or non-processive telomerase catalytic activity; telomerase processivity; conventional reverse transcriptase activity; nucleolytic activity; primer or substrate binding activity; dNTP binding activity; RNA binding activity; telomerase RNP assembly; and protein binding activity). It will be appreciated that there is not necessarily a sharp delineation between changes in "activity" and changes in "expression," and that these terms are used for ease of discussion and not for limitation. It will also be appreciated that the modulators of the invention should specifically affect telomerase activity or expression (e.g., without generally changing the expression of housekeeping proteins such as actin) rather than, for example, reducing expression of a telomerase component by nonspecific poisoning of a target cell.

B. Assays for Identification of Telomerase Modulators

The invention provides methods and reagents to screen for compositions or compounds capable of affecting expression of a telomerase or telomerase component, capable of modifying the DNA replicative capacity of telomerase, or otherwise modifying the ability of the telomerase enzyme and TRT protein to synthesize telomeric DNA ("full activity"). The invention also provides screens for modulators of any or all of hTRT's "partial activities." Thus, the present invention provides assays that can be used to screen for agents that increase the activity of telomerase, for example, by causing hTRT protein or telomerase to be expressed in a cell in which it normally is not expressed or by increasing telomerase activity levels in telomerase positive cells.

Telomerase or telomerase subunit proteins or their catalytic or immunogenic fragments or oligopeptides thereof, can be used for screening therapeutic compounds in any of a variety of drug screening techniques. The fragment employed in such a test may be free in solution, affixed to a solid support, borne on a cell surface, or located intracellularly. The formation of binding complexes, between telomerase or the subunit protein and the agent being tested, may be measured.

In various embodiments, the invention includes methods for screening for antagonists that: bind to the enzyme's active site; inhibit the association of its RNA moiety, telomerase-associated proteins, nucleotides, or telomeric DNA to telomerase or hTRT protein; promote the disassociation of the enzyme complex; interfere with transcription of the telomerase RNA moiety (e.g., hTR); or inhibit any of the "partial activities" described herein. The invention provides methods for screening for compositions that inhibit the association of nucleic acid and/or telomerase-associated compositions with hTRT, such as the association of hTR with hTRT or the association of hTRT with the human homologs of p80 or p95 or another associated protein, or association of hTRT with a telomere or a nucleotide; screening for compositions that promote the disassociation or promote the association (i.e., assembly) of the enzyme complex, such as an antibody directed to hTR or hTRT; screening for agents that effect the processivity of the enzyme; and screening for nucleic acids and other compositions that bind to telomerase, such as a nucleic acid complementary to hTR. The invention further contemplates screening for compositions that increase or decrease the transcription of the hTRT gene and/or translation of the hTRT gene product. The invention also contemplates a method of screening for telomerase modulators in animals, in one embodiment, by reconstituting a telomerase activity, or an anti-telomerase activity, in an animal, such as a transgenic animal. The invention provides for in vivo assays systems that include "knockout" models, in which one or several units of the endogenous telomerase, telomerase RNA moiety and/or telomerase-associated proteins have been deleted or inhibited. The endogenous telomerase activity, full or partial, can remain or be absent. In one embodiment, an exogenous telomerase activity, full or partial, is reconstituted.

In one embodiment of the invention, a variety of partial activity telomerase assays are provided to identify a variety of different classes of modulators of telomerase activity. The "partial activity" assays of the invention allow identification of classes of telomerase activity modulators that might otherwise not be detected in a "full activity" telomerase assay. One partial activity assay involves the non-processive activity of TRT and telomerase. The processive nature of telomerase is described by Morin (1989) *Cell* 59:521-529; see also Prowse (1993) "Identification of a nonprocessive telomerase activity from mouse cells" *Proc. Natl. Acad. Sci. USA* 90:1493-1497. Another partial activity assay of the invention exploits the "reverse-transcriptase-like" activity of telomerase. In these assays, one assays the reverse transcriptase activity of the hTRT protein. See Lingner (1997) "Reverse transcriptase motifs in the catalytic subunit of telomerase" *Science* 276:561-567. Another partial activity assay of the invention exploits the "nucleolytic activity" of hTRT and telomerase, involving the enzyme's removing of at least one nucleotide, typically guanosine, from the 3' strand of a primer. This nucleolytic activity has been observed in *Tetrahymena* telomerase by Collins (1993) "*Tetrahymena* telomerase catalyzes nucleolytic cleavage and nonprocessive elongation" *Genes Dev* 7:1364-1376. Another partial activity assay of the invention involves analyzing hTRT's and telomerase's ability to bind nucleotides as part of its enzymatic processive DNA polymerization activity. Another partial activity assay of the invention involves analyzing hTRT's or telomerase's ability to bind its RNA moiety, i.e., hTR for human cells, used as a template for telomere synthesis. Additional partial activity assays of the invention involve analyzing hTRT's and telomerase's ability to bind chromosomes in vivo, or to bind oligonucleotide primers in vitro or in reconstituted systems, or to bind proteins associated with chromosomal structure (see, for an example of such a protein, Harrington (1995) *J Biol Chem* 270: 8893-8901). Chromosomal structures which bind hTRT include, for example, telomeric repeat DNA, telomere proteins, histones, nuclear matrix protein, cell division/cell cycle control proteins and the like.

In one embodiment, an assay for identification of modulators comprises contacting one or more cells (i.e., "test cells") with a test compound, and determining whether the test compound affects expression or activity of a telomerase (or telomerase component) in the cell. Usually this determination comprises comparing the activity or expression in the test cell compared to a similar cell or cells (i.e., control cells) that have not been contacted with the test compound. Alternatively, cell extracts may be used in place of intact cells. In a related embodiment, the test compound is administered to a multicellular organism (e.g., a plant or animal). The telomerase or telomerase component may be wholly endogenous to the cell or multicellular organism (i.e., encoded by naturally occurring endogenous genes), or may be a recombinant cell or transgenic organism comprising one or more recombinantly expressed telomerase components (e.g., hTRT, hTR, telomerase-associated proteins), or may have both endogenous and recombinant components. Thus, in one embodiment, telomerase-activity-modulators are administered to mortal cells. In another embodiment, telomerase-activity-modulators are administered to immortal cells. For example, antagonists of telomerase-mediated DNA replication can be identified by administering the putative inhibitory composition to a cell that is known to exhibit significant amounts of telomerase activity, such as cancer cells, and measuring whether a decrease in telomerase activity, telomere length, or proliferative capacity is observed, all of which are indicative of a compound with antagonist activity.

In another embodiment, a modulator is identified by monitoring a change in a telomerase activity of a ribonucleoprotein complex (RNP) comprising a TRT (e.g., hTRT) and a template RNA (e.g., hTR), which RNP is reconstituted in vitro (e.g., as described in Example 7, infra).

In yet another embodiment, the modulator is identified by monitoring a change in expression of a TRT gene product (e.g., RNA or protein) in a cell, animal, in vitro expression system, or other expression system.

In still another embodiment, the modulator is identified by changing the expression of a reporter gene, such as that described in Example 15, whose expression is regulated, in whole or part, by a naturally occurring TRT regulatory element such as a promoter or enhancer. In a related embodiment, the ability of a test compound to bind to a telomerase component (e.g., hTRT), RNA, or gene regulatory sequence (e.g., the TRT gene promoter) is assayed.

In another embodiment, the modulator is identified by observing changes in hTRT pre-mRNA processing, for example, alternatively spliced products, alternative polyadenylation events, RNA cleavage, and the like. In a related embodiment the activity of the modulator can be observed by monitoring the production of variant hTRT polypeptides, some of which may possess dominant-negative telomerase regulation activity.

Assay formats for identification of compounds that affect expression and activity of proteins are well known in the biotechnological and pharmaceutical industries, and numerous additional assays and variations of the illustrative assays provided supra will be apparent to those of skill.

Changes in telomerase activity or expression can be measured by any suitable method. Changes in levels of expression of a telomerase component (e.g., hTRT protein) or precursor (e.g., hTRT mRNA) can be assayed using methods well known to those of skill, some of which are described hereinabove, e.g., in Section 1× and including monitoring levels of TRT gene products (e.g., protein and RNAs) by hybridization (e.g., using the TRT probes and primers of the invention), immunoassays (e.g., using the anti-TRT antibodies of the invention), RNAse protection assays, amplification assays, or any other suitable detection means described herein or known in the art. Quantitating amounts of nucleic acid in a sample (e.g., evaluating levels of RNA, e.g., hTR or hTRT mRNA) is also useful in evaluating cis- or trans-transcriptional regulators.

Similarly, changes in telomerase activity can be measured using methods such as those described herein (e.g., in Section IV(B), supra) or other assays of telomerase function. Quantitation of telomerase activity, when desired, may be carried out by any method, including those disclosed herein. Telomerase antagonists that can cause or accelerate loss of telomeric structure can be identified by monitoring and measuring their effect on telomerase activity in vivo, ex vivo, or in vitro, or by their effects on telomere length (as measured or detected through staining, use of tagged hybridization probes or other means) or, simply, by the inhibition of cell division of telomerase positive cancer cells (critical shortening of telomeres leads to a phenomenon termed "crisis" or M2 senescence (Shay, 1991) *Biochem. Biophys. Acta* 1072:1-7), which cancer cells have bypassed by the activation of telomerase, but which, in the absence of telomerase, will lead to their senescence or death through chromosomal deletion and rearrangement). The in vivo human telomerase activity reconstitution provides for a method of screening for telomerase modulators in cells or animals from any origin. Such agonists can be identified in an activity assay of the invention, including measurements of changes in telomere length. Other examples of assays measuring telomerase activity in cells include assays for the accumulation or loss of telomere structure, the TRAP assay or a quantitative polymerase chain reaction assay.

In one embodiment, the assays of the invention also include a method where the test compound produces a statistically significant decrease in the activity of hTRT as measured by the incorporation of a labeled nucleotide into a substrate compared to the relative amount of incorporated label in a parallel reaction lacking the test compound, thereby determining that the test compound is a telomerase inhibitor.

The methods of the invention are amenable to adaptations from protocols described in the scientific and patent literature and known in the art. For example, when a telomerase or TRT protein of this invention is used to identify compositions which act as modulators of telomerase activities, large numbers of potentially useful molecules can be screened in a single test. The modulators can have an inhibitory (antagonist) or potentiating (agonist) effect on telomerase activity. For example, if a panel of 1,000 inhibitors is to be screened, all 1,000 inhibitors can potentially be placed into one microtiter well and tested simultaneously. If such an inhibitor is discovered, then the pool of 1,000 can be subdivided into 10 pools of 100 and the process repeated until an individual inhibitor is identified.

In drug screening large numbers of compounds are examined for their ability to act as telomerase modulators, a process greatly accelerated by the techniques of high throughput screening. The assays for telomerase activity, full or partial, described herein may be adapted to be used in a high throughput technique. Those skilled in the art appreciate that there are numerous methods for accomplishing this purpose.

Another technique for drug screening which may be applied for high throughput screening of compounds having suitable binding affinity to the telomerase or telomerase protein subunit is described in detail in "Determination of Amino Acid Sequence Antigenicity" by Geysen, (Geysen, WO Application 84/03564, published on Sep. 13, 1984, incorporated herein by reference). In summary, large numbers of different small peptide test compounds are synthesized on a solid substrate, such as plastic pins or some other surface. The peptide test compounds are reacted with fragments of telomerase or telomerase protein subunits and washed. Bound telomerase or protein subunit is then detected by methods well known in the art. Substantially purified telomerase or telomerase protein subunit can also be coated directly onto plates for use in the aforementioned drug screening techniques. Alternatively, non-neutralizing antibodies can be used to capture the peptide and immobilize it on a solid support.

This invention also contemplates the use of competitive drug screening assays in which neutralizing antibodies capable of binding telomerase or subunit protein(s) specifically compete with a test compound for binding telomerase or the subunit protein. Antibodies can also be used to detect the presence of any peptide which shares one or more antigenic determinants with the telomerase or subunit protein.

Additional methods for identifying modulators of a telomerase activity have been described in U.S. Pat. No. 5,645,986, which is incorporated herein by reference. It will be appreciated that the present invention provides improvements to previously known methods, in part by providing reagents such as hTRT polynucleotides, probes and primers, highly purified hTR, hTRT and telomerase, as well as anti-telomerase and anti-TRT antibodies, all of which may be used in assays, e.g., as controls, standards, binding or hybridization agents, or otherwise.

It will be recognized that the recombinantly produced telomerase and TRT (e.g., hTRT) of the invention will be useful in assays for identification of modulators. The screening assay can utilize telomerase or hTRT derived by a full or partial reconstitution of telomerase activity, or by an augmentation of existing activity. The assay or screens provided by the invention can be used to test for the ability of telomerase to synthesize telomeric DNA or to test for any one or all or of the "partial activities" of hTRT and TRTs generally, as described above. The assay can incorporate ex vivo modification of cells which have been manipulated to express telomerase with or without its RNA moiety or associated proteins, and these can be re-implanted into an animal, which can be used for in vivo testing. Thus, this invention provides in vivo assays and transgenic animals useful therein. These in vivo assays systems can employ "knockout" cells, in which one or several units of the endogenous telomerase enzyme complex have been deleted or inhibited, as well as cells in which an exogenous or endogenous telomerase activity is reconstituted or activated.

Telomerases and TRT proteins that have been modified in a site-specific manner (by site-specific mutation) to modify or delete any or all functions of the telomerase enzyme or the TRT protein can also be employed in the screens of the invention to discover therapeutic agents. For example, the TRT can be engineered to lose its ability to bind substrate DNA, to bind its RNA moiety (as hTR), to catalyze the addition of telomeric DNA, to bind deoxynucleotide substrate, to have nucleolytic activity, to bind telomere-associated proteins or chromosomal structures, and the like. The resulting "mutant proteins" or "muteens" can be used to identify compounds that specifically modulate one, several, or all functions or activities of the TRT protein or telomerase.

C. Exemplary Telomerase Modulators

1) Generally

The test compounds referred to supra may be any of a large variety of compounds, both naturally occurring and synthetic, organic and inorganic, and including polymers (e.g., oligopeptides, polypeptides, oligonucleotides, and polynucleotides), small molecules, antibodies (as broadly defined herein), sugars, fatty acids, nucleotides and nucleotide analogs, analogs of naturally occurring structures (e.g., peptide mimetics, nucleic acid analogs, and the like), and numerous other compounds.

The invention provides modulators of all types, without limitation to any particular mechanism of action. For illustrative purposes, examples of modulators include compounds or treatments that:

(i) bind to the hTRT polypeptide (e.g., the active site of the enzyme) or other telomerase component, and affect a telomerase activity;

(ii) inhibit or promote association, or inhibit or promote disassociation, of a telomerase component (e.g., hTRT or the hTRT-hTR RNP) with or from a telomerase-associated protein (e.g., including those described in Section IV(D), supra);

(iii) inhibit or promote association, or inhibit or promote disassociation, of telomerase polypeptides (e.g., hTRT) with or from a telomerase RNA (e.g., hTR);

(iv) inhibit or promote association, or inhibit or promote disassociation, of telomerase polypeptides (e.g., hTRT) with or from chromosomes (e.g., telomeres) or chromosomal DNA (e.g. telomeric DNA);

(v) increase or decrease expression of a telomerase component gene product (e.g., products of the hTRT gene), including change the rate or level of transcription of the TRT gene, or translation, transport or stability of a gene product, or the like, by binding to the gene or gene product (e.g., by interacting with a factor (e.g., a transcription regulatory protein) that affects transcription of the hTRT gene or another telomerase component).

2) Peptide Modulators

Potential modulators of telomerase activity also include peptides (e.g., inhibitory (antagonist) and activator (agonist) peptide modulators). For example, oligopeptides with randomly generated sequences can be screened to discover peptide modulators (agonists or inhibitors) of telomerase activity. Such peptides can be used directly as drugs or to find the orientation or position of a functional group that can inhibit telomerase activity that, in turn, leads to design and testing of a small molecule inhibitor, or becomes the backbone for chemical modifications that increase pharmacological utility. Peptides can be structural mimetics, and one can use molecular modeling programs to design mimetics based on the characteristic secondary structure and/or tertiary structure of telomerase enzyme and hTRT protein. Such structural mimetics can also be used therapeutically, in vivo, as modulators of telomerase activity (agonists and antagonists). Structural mimetics can also be used as immunogens to elicit anti-telomerase or anti-TRT protein antibodies.

3) Inhibitory Natural Compounds as Modulators of Telomerase Activity

In addition, a large number of potentially useful activity-modifying compounds can be screened in extracts from natural products as a source material. Sources of such extracts can be from a large number of species of fungi, actinomyces, algae, insects, protozoa, plants, and bacteria. Those extracts showing inhibitory activity can then be analyzed to isolate the active molecule. See for example, Turner (1996) *J. Ethnopharmacol* 51(1-3):39-43; Suh (1995) *Anticancer Res.* 15:233-239.

4) Inhibitory Oligonucleotides

One particularly useful set of inhibitors provided by the present invention includes oligonucleotides which are able to either bind mRNA encoding hTRT protein or to the hTRT gene, in either case preventing or inhibiting the production of functional hTRT protein. Other oligonucleotides of the invention interact with telomerase's RNA moiety, such as hTR, or are able to prevent binding of telomerase or hTRT to its DNA target, or one telomerase component to another, or to a substrate. Such oligonucleotides can also bind the telomerase enzyme, hTRT protein, or both protein and RNA and inhibit a partial activity as described above (such as its processive activity, its reverse transcriptase activity, its nucleolytic activity, and the like). The association can be through sequence specific hybridization to another nucleic acid or by general binding, as in an aptamer, or both.

Telomerase activity can be inhibited by targeting the hTRT mRNA with antisense oligonucleotides capable of binding the hTRT mRNA.

Another useful class of inhibitors includes oligonucleotides which cause inactivation or cleavage of hTRT mRNA or hTR. That is, the oligonucleotide is chemically modified, or has enzyme activity, which causes such cleavage, such as is the case for a ribozyme, an EDTA-tethered oligonucleotide, or a covalently bound oligonucleotide, such as a psoralen or other cross-linking reagent bound oligonucleotide. As noted above, one may screen a pool of many different such oligonucleotides for those with the desired activity.

Another useful class of inhibitors includes oligonucleotides which bind polypeptides. Double- or single-stranded DNA or double- or single-stranded RNA molecules that bind to specific polypeptides targets are called "aptamers." The specific oligonucleotide-polypeptide association may be mediated by electrostatic interactions. For example, aptamers specifically bind to anion-binding exosites on thrombin, which physiologically binds to the polyanionic heparin (Bock (1992) *Nature* 355:564-566). Because hTRT protein binds both hTR and its DNA substrate, and because the present invention provides hTRT and other TRT proteins in purified form in large quantities, those of skill in the art can readily screen for TRT-binding aptamers using the methods of the invention.

Oligonucleotides (e.g., RNA oligonucleotides) that bind telomerase, hTRT, hTR, or portions thereof, can be generated using the techniques of SELEX (Tuerk, 1997, *Methods Mol Biol* 67, 2190). In this technique a very large pool (106-109) of random sequence nucleic acids is bound to the target (e.g. hTRT) using conditions that cause a large amount of discrimination between molecules with high affinity and low affinity for binding the target. The bound molecules are separated from unbound, and the bound molecules are amplified by virtue of a specific nucleic acid sequence included at their termini and suitable amplification reagents. This process is reiterated several times until a relatively small number of molecules remain that possess high binding affinity for the target. These molecules can then be tested for their ability to modulate telomerase activity as described herein.

Antagonists of telomerase-mediated DNA replication can also be based on inhibition of hTR (Norton (1996) *Nature Biotechnology* 14:615-619) through complementary sequence recognition or cleavage, as through ribozymes.

The inhibitory oligonucleotides of the invention can be transferred into the cell using a variety of techniques well known in the art. For example, oligonucleotides can be delivered into the cytoplasm without specific modification. Alternatively, they can be delivered by the use of liposomes which fuse with the cellular membrane or are endocytosed, i.e., by employing ligands attached to the liposome or directly to the oligonucleotide, that bind to surface membrane protein receptors of the cell resulting in endocytosis. Alternatively, the cells may be permeabilized to enhance transport of the oligonucleotides into the cell, without injuring the host cells. One can use a DNA binding protein, e.g., HBGF-1, known to transport an oligonucleotide into a cell.

5) Inhibitory Ribozymes

Ribozymes act by binding to a target RNA through the target RNA binding portion of a ribozyme which is held in close proximity to an enzymatic portion of the ribozyme that cleaves the target RNA. Thus, the ribozyme recognizes and binds a target RNA usually through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it is typically released from that RNA and so can bind and cleave new targets repeatedly.

6) Identifying Telomerase-Associated Proteins for Use as Modulators

In one embodiment of the invention, telomerase is used to identify telomerase associated proteins, i.e., telomerase accessory proteins which modulate or otherwise complement telomerase activity. As noted above, these proteins or fragments thereof can modulate function by causing the dissociation or preventing the association of the telomerase enzyme complex, preventing the assembly of the telomerase complex, preventing hTRT from binding to its nucleic acid complement or to its DNA template, preventing hTRT from binding nucleotides, or preventing, augmenting, or inhibiting any one, several or all of the partial activities of the telomerase enzyme or hTRT protein, as described above.

One of skill in the art can use the methods of the invention to identify which portions (e.g., domains) of these telomerase-associating proteins contact telomerase. In one embodiment of the invention, these telomerase-associating proteins or fragments thereof are used as modulators of telomerase activity.

7) Telomerase-Associated Proteins as Dominant Negative Mutants

In one embodiment of the invention, telomerase-associated proteins are used as modulators of telomerase activity. Telomerase-associated proteins include chromosomal structures, such as histones, nuclear matrix proteins, cell division and cell cycle control proteins, and the like. Other telomerase-associated proteins which can be used as modulators for the purpose of the invention include the p80 and p95 proteins and their human homologs, such as TP1 and TRF-1 (Chong, 1995, Science 270:1663-1667). In addition, fragments of these telomerase-associated proteins can be identified by the skilled artisan in accordance with the methods of the invention and used as modulators of telomerase activity.

8) Dominant Negative Mutants

Eight highly conserved motifs have been identified between TRTs of different non-human species, as described above (see also Lingner (1997) Science 276:561-567). FIG. 4 shows a schematic of the human TRT amino acid sequence (from pGRN121) and RT motifs as compared to S. pombe Trt1p, Euplotes p123 and S. cerevisiae Est2 p. The present invention provides recombinant and synthetic nucleic acids in which the codons for the conserved amino acid residues in each, alone or in conjunction with one or more additional codons, of all eight of these motifs has been a changed to each of the other codons. A variety of the resulting coding sequences express a non-functional hTRT. See, for instance, Example 16. Thus, the present invention provides, for example, a wide variety of "mutated" telomerase enzymes and TRT proteins which have a partial activity but not full activity of telomerase. For example, one such telomerase is able to bind telomeric structures, but not bind telomerase-associated RNA (i.e., hTR). If expressed at high enough levels, such a telomerase mutant can deplete a necessary telomerase component (e.g., hTR) and thereby function as an inhibitor of wild-type telomerase activity. A mutated telomerase acting in this manner is an antagonist or a so-called "dominant-negative" mutant.

9) Antibodies

In general, the antibodies of the invention can be used to identify, purify, or inhibit any or all activity of telomerase enzyme and hTRT protein. Antibodies can act as antagonists of telomerase activity in a variety of ways, for example, by preventing the telomerase complex or nucleotide from binding to its DNA substrates, by preventing the components of telomerase from forming an active complex, by maintaining a functional (telomerase complex) quaternary structure or by binding to one of the enzyme's active sites or other sites that have allosteric effects on activity (the different partial activities of telomerase are described in detail elsewhere in this specification).

D) Modulator Synthesis

It is contemplated that the telomerase modulators of the invention will be made using methods well known in the pharmaceutical arts, including combinatorial methods and rational drug design techniques.

1) Combinatorial Chemistry Methodology

The creation and simultaneous screening of large libraries of synthetic molecules can be carried out using well-known techniques in combinatorial chemistry, for example, see van Breemen (1997) Anal Chem 69:2159-2164; Lam (1997) Anticancer Drug Des 12:145-167 (1997).

As noted above, combinatorial chemistry methodology can be used to create vast numbers of oligonucleotides (or other compounds) that can be rapidly screened for specific oligonucleotides (or compounds) that have appropriate binding affinities and specificities toward any target, such as the TRT proteins of the invention, can be utilized (for general background information Gold (1995) J. of Biol. Chem. 270:13581-13584).

2) Rational Drug Design

Rational drug design involves an integrated set of methodologies that include structural analysis of target molecules, synthetic chemistries, and advanced computational tools. When used to design modulators, such as antagonists/inhibitors of protein targets, such as telomerase enzyme and hTRT protein, the objective of rational drug design is to understand a molecule's three-dimensional shape and chemistry. Rational drug design is aided by X-ray crystallographic data or NMR data, which can now be determined for the hTRT protein and telomerase enzyme in accordance with the methods and using the reagents provided by the invention. Calculations on electrostatics, hydrophobicities and solvent accessibility is also helpful. See, for example, Coldren (1997) Proc. Natl. Acad. Sci. USA 94:6635-6640.

E) Kits

The invention also provides kits that can be used to aid in determining whether a test compound is a modulator of a TRT activity. The kit will typically include one or more of the following components: a substantially purified TRT polypeptide or polynucleotide (including probes and primers); a plasmid capable of expressing a TRT (e.g., hTRT) when introduced into a cell or cell-free expression system; a plasmid capable of expressing a TR (e.g., hTR) when introduced into a cell or cell-free expression system; cells or cell lines; a composition to detect a change in TRT activity; and, an instructional material teaching a means to detect and measure a change in the TRT activity, indicating that a change in the telomerase activity in the presence of the test compound is an indicator that the test compound modulates the telomerase activity, and one or more containers. The kit can also include means, such as TRAP assay reagents or reagents for a quantitative polymerase chain reaction assay, to measure a change in TRT activity. The kit may also include instructional material teaching a means to detect and measure a change in the TRT activity, indicating that a change in the telomerase activity in the presence of the test compound is an indicator that the test compound modulates the telomerase activity.

XI. TRANSGENIC ORGANISMS (TELOMERASE KNOCKOUT CELLS AND ANIMAL MODELS)

The invention also provides transgenic non-human multicellular organisms (e.g., plants and non-human animals) or unicellular organisms (e.g., yeast) comprising an exogenous TRT gene sequence, which may be a coding sequence or a regulatory (e.g., promoter) sequence. In one embodiment, the organism expresses an exogenous TRT polypeptide, having a sequence of a human TRT protein. In a related embodiment, the organism also expresses a telomerase RNA component (e.g., hTR).

The invention also provides unicellular and multicellular organisms (or cells therefrom) in which at least one gene encoding a telomerase component (e.g., TRT or TR) or telomerase-associated protein is mutated or deleted (i.e., in a coding or regulatory region) such that native telomerase is not expressed, or is expressed at reduced levels or with different activities when compared to wild-type cells or organisms. Such cells and organisms are often referred to as "gene knock-out" cells or organisms.

The invention further provides cells and organisms in which an endogenous telomerase gene (e.g., murine TRT) is either present or optionally mutated or deleted and an exogenous telomerase gene or variant (e.g., human TRT) is introduced and expressed. Cells and organisms of this type will be useful, for example, as model systems for identifying modulators of hTRT activity or expression; determining the effects of mutations in telomerase component genes, and other uses such as determining the developmental timing and tissue location of telomerase activity (e.g., for assessing when to administer a telomerase modulator and for assessing any potential side effects).

Examples of multicellular organisms include plants, insects, and nonhuman animals such as mice, rats, rabbits, monkeys, apes, pigs, and other nonhuman mammals. An example of a unicellular organism is a yeast.

Methods for alteration or disruption of specific genes (e.g., endogenous TRT genes) are well known to those of skill, see, e.g., Baudin et al., 1993, *Nucl. Acids Res.* 21:3329; Wach et al., 1994, *Yeast* 10:1793; Rothstein, 1991, *Methods Enzymol.* 194:281; Anderson, 1995, *Methods Cell Biol.* 48:31; Pettitt et al., 1996, *Development* 122:4149-4157; Ramirez-Solis et al., 1993, *Methods Enzymol.* 225:855; and Thomas et al., 1987, *Cell* 51:503, each of which is incorporated herein by reference in its entirety for all purposes.

The "knockout" cells and animals of the invention include cells and animals in which one or several units of the endogenous telomerase enzyme complex have beer deleted or inhibited. Reconstitution of telomerase activity will save the cell or animal from senescence or, for cancer cells, cell death caused by its inability to maintain telomeres. Methods of altering the expression of endogenous genes are well known to those of skill in the art. Typically, such methods involve altering or replacing all or a portion of the regulatory sequences controlling expression of the particular gene to be regulated. The regulatory sequences, e.g., the native promoter can be altered. The conventional technique for targeted mutation of genes involves placing a genomic DNA fragment containing the gene of interest into a vector, followed by cloning of the two genomic arms associated with the targeted gene around a selectable neomycin-resistance cassette in a vector containing thymidine kinase. This "knock-out" construct is then transfected into the appropriate host cell, i.e., a mouse embryonic stem (ES) cell, which is subsequently subjected to positive selection (using G418, for example, to select for neomycin-resistance) and negative selection (using, for example, FIAU to exclude cells lacking thymidine kinase), allowing the selection of cells which have undergone homologous recombination with the knock-out vector. This approach leads to inactivation of the gene of interest. See, e.g., U.S. Pat. Nos. 5,464,764; 5,631,153; 5,487,992; and, 5,627,059.

"Knocking out" expression of an endogenous gene can also be accomplished by the use of homologous recombination to introduce a heterologous nucleic acid into the regulatory sequences (e.g., promoter) of the gene of interest. To prevent expression of functional enzyme or product, simple mutations that either alter the reading frame or disrupt the promoter can be suitable. To up-regulate expression, a native promoter can be substituted with a heterologous promoter that induces higher levels of transcription. Also, "gene trap insertion" can be used to disrupt a host gene, and mouse ES cells can be used to produce knockout transgenic animals, as described for example, in Holzschu (1997) *Transgenic Res* 6: 97-106.

Altering the expression of endogenous genes by homologous recombination can also be accomplished by using nucleic acid sequences comprising the structural gene in question. Upstream sequences are utilized for targeting heterologous recombination constructs. Utilizing TRT structural gene sequence information, such as SEQ ID NO:1, one of skill in the art can create homologous recombination constructs with only routine experimentation. Homologous recombination to alter expression of endogenous genes is described in U.S. Pat. No. 5,272,071, and WO 91/09955, WO 93/09222, WO 96/29411, WO 95/31560, and WO 91/12650. Homologous recombination in mycobacteria is described by Azad (1996) Proc. Natl. Acad. Sci. USA 93:4787; Baulard (1996) J. Bacteriol. 178:3091; and Pelicic (1996) Mol. Microbiol. 20:919. Homologous recombination in animals has been described by Moynahan (1996) Hum. Mol. Genet. 5:875, and in plants by Offringa (1990) EMBO J. 9:3077.

XII. GLOSSARY

The following terms are defined infra to provide additional guidance to one of skill in the practice of the invention: adjuvant, allele (& allelic sequence), amino acids (including hydrophobic, polar, charged), conservative substitution, control elements (& regulatory sequences), derivatized, detectable label, elevated level, epitope, favorable and unfavorable prognosis, fusion protein, gene product, hTR, immortal, immunogen and immunogenic, isolated, modulator, motif, nucleic acid (& polynucleotide), oligonucleotides (& oligomers), operably linked, polypeptide, probe (including nucleic acid probes & antibody probes), recombinant, selection system, sequence, specific binding, stringent hybridization conditions (& stringency), substantial identity (& substantial similarity), substantially pure (& substantially purified), telomerase-negative and telomerase-positive cells, telomerase catalytic activity, telomerase-related, and test compound.

As used herein, the term "adjuvant" refers to its ordinary meaning of any substance that enhances the immune response to an antigen with which it is mixed. Adjuvants useful in the present invention include, but are not limited to, Freund's, mineral gels such as aluminum hydroxide, and surface active substances such as lysolecithin, pluronic polyols, polyanions, peptides, oil emulsions, keyhole limpet hemocyanin, and dinitrophenol. BCG (Bacillus Calmette-Guerin) and *Corynebacterium parvum* are potentially useful adjuvants.

As used herein, the terms "allele" or "allelic sequence" refer to an alternative form of a nucleic acid sequence (i.e., a nucleic acid encoding hTRT protein). Alleles result from mutations (i.e., changes in the nucleic acid sequence), and generally produce altered and/or differently regulated mRNAs or polypeptides whose structure and/or function may or may not be altered. Common mutational changes that give rise to alleles are generally ascribed to natural deletions, additions, or substitutions of nucleotides that may or may not affect the encoded amino acids. Each of these types of changes may occur alone, in combination with the others, or one or more times within a given gene, chromosome or other cellular nucleic acid. Any given gene may have no, one or many allelic forms. As used herein, the term "allele" refers to either or both a gene or an mRNA transcribed from the gene.

As used herein, "amino acids" are sometimes specified using the standard one letter code: Alanine (A), Serine (S), Threonine (T), Aspartic acid (D), Glutamic acid (E) Asparagine (N), Glutamine (Q), Arginine (R), Lysine (K), Isoleucine (I), Leucine (L), Methionine (M), Valine (V), Phenylalanine (F), Tyrosine (Y), Tryptophan (W), Proline (P), Glycine (G), Histidine (H), Cysteine (C). Synthetic and non-naturally occurring amino acid analogues (and/or peptide linkages) are included.

As used herein, "Hydrophobic amino acids" refers to A, L, I, V, P, F, W, and M. As used herein, "polar amino acids" refers to G, S, T, Y, C, N, and Q. As used herein, "charged amino acids" refers to D, E, H, K, and R.

As used herein, "conservative substitution", when describing a protein refers to a change in the amino acid composition of the protein that does not substantially alter the protein's activity. Thus, "conservatively modified variations" of a particular amino acid sequence refers to amino acid substitutions of those amino acids that are not critical for protein activity or substitution of amino acids with other amino acids having similar properties (e.g., acidic, basic, positively or negatively charged, polar or non-polar, etc.) such that the substitutions of even critical amino acids does not substantially alter activity. Conservative substitution tables providing functionally similar amino acids are well known in the art. The following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W) (see also, Creighton (1984) *Proteins*, W.H. Freeman and Company). One of skill in the art will appreciate that the above-identified substitutions are not the only possible conservative substitutions. For example, one may regard all charged amino acids as conservative substitutions for each other whether they are positive or negative. In addition, individual substitutions, deletions or additions which alter, add or delete a single amino acid or a small percentage of amino acids in an encoded sequence can also be "conservatively modified variations". One can also make a "conservative substitution" in a recombinant protein by utilizing one or more codons that differ from the codons employed by the native or wild-type gene. In this instance, a conservative substitution also includes substituting a codon for an amino acid with a different codon for the same amino acid.

As used herein, "control elements" or "regulatory sequences" include enhancers, promoters, transcription terminators, origins of replication, chromosomal integration sequences, 5' and 3' untranslated regions, with which proteins or other biomolecules interact to carry out transcription and translation. For eukaryotic cells, the control sequences will include a promoter and preferably an enhancer, e.g., derived from immunoglobulin genes, SV40, cytomegalovirus, and a polyadenylation sequence, and may include splice donor and acceptor sequences. Depending on the vector system and host utilized, any number of suitable transcription and translation elements, including constitutive and inducible promoters, may be used As used herein, a "derivatized" polynucleotide, oligonucleotide, or nucleic acid refers to oligo- and polynucleotides that comprise a derivatized substituent. In some embodiments, the substituent is substantially non-interfering with respect to hybridization to complementary polynucleotides. Derivatized oligo- or polynucleotides that have been modified with appended chemical substituents (e.g., by modification of an already synthesized oligo- or poly-nucleotide, or by incorporation of a modified base or backbone analog during synthesis) may be introduced into a metabolically active eukaryotic cell to hybridize with an hTRT DNA, RNA, or protein where they produce an alteration or chemical modification to a local DNA, RNA, or protein. Alternatively, the derivatized oligo or polynucleotides may interact with and alter hTRT polypeptides, telomerase-associated proteins, or other factors that interact with hTRT DNA or hTRT gene products, or alter or modulate expression or function of hTRT DNA, RNA or protein. Illustrative attached chemical substituents include: europium (III) texaphyrin, cross-linking agents, psoralen, metal chelates (e.g., iron/EDTA chelate for iron catalyzed cleavage), topoisomerases, endonucleases, exonucleases, ligases, phosphodiesterases, photodynamic porphyrins, chemotherapeutic drugs (e.g., adriamycin, doxirubicin), intercalating agents, base-modification agents, immunoglobulin chains, and oligonucleotides. Iron/EDTA chelates are chemical substituents often used where local cleavage of a polynucleotide sequence is desired (Hertzberg et al., 1982, *J. Am. Chem. Soc.* 104: 313; Hertzberg and Dervan, 1984, *Biochemistry* 23: 3934; Taylor et al., 1984, *Tetrahedron* 40: 457; Dervan, 1986, *Science* 232: 464. Illustrative attachment chemistries include: direct linkage, e.g., via an appended reactive amino group (Corey and Schultz (1988) *Science* 238: 1401, which is incorporated herein by reference) and other direct linkage chemistries, although streptavidin/biotin and digoxigenin/anti-digoxigenin antibody linkage methods can also be used. Methods for linking chemical substituents are provided in U.S. Pat. Nos. 5,135,720, 5,093,245, and 5,055,556, which are incorporated herein by reference. Other linkage chemistries may be used at the discretion of the practitioner.

As used herein, a "detectable label" has the ordinary meaning in the art and refers to an atom (e.g., radionuclide), molecule (e.g., fluorescein), or complex, that is or can be used to detect (e.g., due to a physical or chemical property), indicate the presence of a molecule or to enable binding of another molecule to which it is covalently bound or otherwise associated. The term "label" also refers to covalently bound or otherwise associated molecules (e.g., a biomolecule such as an enzyme) that act on a substrate to produce a detectable atom, molecule or complex. Detectable labels suitable for use in the present invention include any composition detectable by spectroscopic, photochemical, biochemical, immunochemical, electrical, optical or chemical means. Labels useful in the present invention include biotin for staining with labeled streptavidin conjugate, magnetic beads (e.g., Dynabeads™), fluorescent dyes (e.g., fluorescein, Texas red, rhodamine, green fluorescent protein, enhanced green fluorescent protein, lissamine, phycoerythrin, Cy2, Cy3, Cy3.5, Cy5, Cy5.5, Cy7, Fluor X [Amersham], SyBR Green I & II [Molecular Probes], and the like), radiolabels (e.g., $^3$H, $^{125}$I, $^{35}$S, $^{14}$C, or $^{32}$P), enzymes (e.g., hydrolases, particularly phosphatases such as alkaline phosphatase, esterases and glycosidases, or oxidoreductases, particularly peroxidases such as horse radish peroxidase, and others commonly used in ELISAs), substrates, cofactors, inhibitors, chemiluminescent groups, chromogenic agents, and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241. Means of detecting such labels are well known to those of skill in the art. Thus, for example, radiolabels and chemiluminescent labels may be detected using photographic film or scintillation counters, fluorescent markers may be detected using a photodetector to detect emitted light (e.g., as in fluorescence-activated cell sorting). Enzymatic labels are typically detected by providing the enzyme with a substrate and detecting the reaction product produced by the action of the enzyme on the substrate, and colorimetric labels are detected by simply visualizing the colored label. Thus, a label is any composition detectable by spectroscopic, photochemical, biochemical, immunochemical, electrical, optical or chemical means. The label may be coupled directly or indirectly to the desired component of the assay according to methods well known in the art. Non-radioactive labels are often attached by indirect means. Generally, a ligand molecule (e.g., biotin) is covalently bound to the molecule. The ligand then binds to an anti-ligand (e.g., streptavidin) molecule which is either inherently detectable or covalently bound to a signal generating system, such as a detectable enzyme, a fluorescent compound, or a chemiluminescent compound. A number of ligands and anti-ligands can be used. Where a ligand has a natural anti-ligand, for example, biotin, thyroxine, and cortisol, it can be used in conjunction with the labeled, naturally occurring anti-ligands. Alternatively, any haptenic or antigenic compound can be used in combination with an antibody. The molecules can also be conjugated directly to signal generating compounds, e.g., by conjugation with an enzyme or fluorophore. Means of detecting labels are well known to those of skill in the art. Thus, for example, where the label is a radioactive label, means for detection include a scintillation counter, photographic film as in autoradiography, or storage phosphor imaging. Where the label is a fluorescent label, it may be detected by exciting the fluorochrome with the appropriate wavelength of light and detecting the resulting fluorescence. The fluorescence may be detected visually, by means of photographic film, by the use of electronic detectors such as charge coupled devices (CCDs) or photomultipliers and the like. Similarly, enzymatic labels may be detected by providing the appropriate substrates for the enzyme and detecting the resulting reaction product. Also, simple colorimetric labels may be detected by observing the color associated with the label. It will be appreciated that when pairs of fluorophores are used in an assay, it is often preferred that the they have distinct emission patterns (wavelengths) so that they can be easily distinguished.

The phrase "elevated level" refers to an amount of hTRT gene product (or other specified substance or activity) in a cell that is elevated or higher than the level in a reference standard, e.g., for diagnosis, the level in normal, telomerase-negative cells in an individual or in other individuals not suffering from the condition, and for prognosis, the level in tumor cells from a variety of grades or classes of, e.g., tumors.

As used herein, the term "epitope" has its ordinary meaning of a site on an antigen recognized by an antibody. Epitopes are typically segments of amino acids which are a small portion of the whole protein. Epitopes may be conformational (i.e., discontinuous). That is, they may be formed from amino acids encoded by noncontiguous parts of a primary sequence that have been juxtaposed by protein folding.

The terms "favorable prognosis" and "unfavorable prognosis" are known in the art. In the context of cancers, "favorable prognosis" means that there is a likelihood of tumor regression or longer survival times for patients with a favorable prognosis relative to those with unfavorable prognosis, whereas "unfavorable prognosis" means that the tumor is likely to be more aggressive, i.e., grow faster and/or metastasize, resulting in a poor outcome or a more rapid course of disease progression for the patient.

As used herein, the term "fusion protein," refers to a composite protein, i.e., a single contiguous amino acid sequence, made up of two (or more) distinct, heterologous polypeptides which are not normally fused together in a single amino acid sequence. Thus, a fusion protein may include a single amino acid sequence that contains two entirely distinct amino acid sequences or two similar or identical polypeptide sequences, provided that these sequences are not normally found together in the same configuration in a single amino acid sequence found in nature. Fusion proteins may generally be prepared using either recombinant nucleic acid methods, i.e., as a result of transcription and translation of a recombinant gene fusion product, which fusion comprises a segment encoding a polypeptide of the invention and a segment encoding a heterologous protein, or by chemical synthesis methods well known in the art. The non-hTRT region(s) of the fusion protein can be fused to the amino terminus of the hTRT polypeptide or the carboxyl terminus, or both or the non-hTRT region can be inserted into the interior of the protein sequence (by moiety inserting or by replacing amino acids) or combinations of the foregoing can be performed.

As used herein, the term "gene product" refers to an RNA molecule transcribed from a gene, or a protein encoded by the gene or translated from the RNA.

As used herein, "hTR" (human telomerase RNA) refers to the RNA component of human telomerase and any naturally occurring alleles and variants or recombinant variants. hTR is described in detail in U.S. Pat. No. 5,583,016 which is incorporated herein by reference in its entirety and for all purposes.

As used herein, the term "immortal," when referring to a cell, has its normal meaning in the telomerase art and refers to cells that have apparently unlimited replicative potential. Immortal can also refer to cells with increased proliferative capacity relative to their unmodified counterparts. Examples of immortal human cells are malignant tumor cells, germ line cells, and certain transformed human cell lines cultured in vitro (e.g., cells that have become immortal following transformation by viral oncogenes or otherwise). In contrast, most normal human somatic cells are mortal, i.e., have limited replicative potential and become senescent after a finite number of cell divisions.

As used herein, the terms "immunogen" and "immunogenic" have their ordinary meaning in the art, i.e, an immunogen is a molecule, such as a protein or other antigen, that can elicit an adaptive immune response upon injection into a person or an animal.

As used herein, "isolated," when referring to a molecule or composition, such as, for example, an RNP (e.g., at least one protein and at least one RNA), means that the molecule or composition is separated from at least one other compound, such as a protein, other RNAs, or other contaminants with which it is associated in vivo or in its naturally occurring state. Thus, an RNP is considered isolated when the RNP has been isolated from any other component with which it is naturally associated, e.g., cell membrane, as in a cell extract. An isolated composition can, however, also be substantially pure.

As used herein, "modulator" refers to any synthetic or natural compound or composition that can change in any way either or both the "full" or any "partial activity" of a telomerase reverse transcriptase (TRT). A modulator can be an agonist or an antagonist. A modulator can be any organic and inorganic compound; including, but not limited to, for example, small molecules, peptides, proteins, sugars, nucleic acids, fatty acids and the like.

As used herein, "motif" refers to a sequence of contiguous amino acids (or to a nucleic acid sequence that encodes a sequence of contiguous amino acids) that defines a feature or structure in a protein that is common to or conserved in all proteins of a defined class or type. The motif or consensus sequence may include both conserved and non-conserved residues. The conserved residues in the motif sequence indicate that the conserved residue or class (i.e., hydrophobic, polar, non-polar, or other class) of residues is typically present at the indicated location in each protein (or gene or mRNA) of the class of proteins defined by the motif. Motifs can differ in accordance with the class of proteins. Thus, for example, the reverse transcriptase enzymes form a class of proteins than can be defined by one or more motifs and this class include telomerase enzymes. However, the telomerase enzymes can also be defined as the class of enzymes with motifs characteristic for that class. Those of skill recognize that the identification of a residue as a conserved residue in a motif does not mean that every member of the class defined by the motif has the indicated residue (or class of residues) at the indicated position, and that one or more members of the class may have a different residue at the conserved position.

As used herein, the terms "nucleic acid" and "polynucleotide" are used interchangeably. Use of the term "polynucleotide" is not intended to exclude oligonucleotides (i.e., short polynucleotides) and can also refer to synthetic and/or non-naturally occurring nucleic acids (i.e., comprising nucleic acid analogues or modified backbone residues or linkages).

As used herein "oligonucleotides" or "oligomers" refer to a nucleic acid sequence of approximately 7 nucleotides or greater, and as many as approximately 100 nucleotides, which can be used as a primer, probe or amplimer. Oligonucleotides are often between about 10 and about 50 nucleotides in length, more often between about 14 and about 35 nucleotides, very often between about 15 and about 25 nucleotides, and the terms oligonucleotides or oligomers can also refer to synthetic and/or non-naturally occurring nucleic acids (i.e., comprising nucleic acid analogues or modified backbone residues or linkages).

As used herein, the term "operably linked," refers to a functional relationship between two or more nucleic acid (e.g., DNA) segments: for example, a promoter or enhancer is operably linked to a coding sequence if it stimulates the transcription of the sequence in an appropriate host cell or other expression system. Generally, sequences that are operably linked are contiguous, and in the case of a signal sequence both contiguous and in reading phase. However, enhancers need not be located in close proximity to the coding sequences whose transcription they enhance.

As used herein, the term "polypeptide" is used interchangeably herein with the term "protein," and refers to a polymer composed of amino acid residues linked by amide linkages, including synthetic, naturally-occurring and non-naturally occurring analogs thereof (amino acids and linkages). Peptides are examples of polypeptides.

As used herein, a "probe" refers to a molecule that specifically binds another molecule. One example of a probe is a "nucleic acid probe" that specifically binds (i.e., anneals or hybridizes) to a substantially complementary nucleic acid. Another example of a probe is an "antibody probe" that specifically binds to a corresponding antigen or epitope.

As used herein, "recombinant" refers to a polynucleotide synthesized or otherwise manipulated in vitro (e.g., "recombinant polynucleotide"), to methods of using recombinant polynucleotides to produce gene products in cells or other biological systems, or to a polypeptide ("recombinant protein") encoded by a recombinant polynucleotide.

As used herein, a "selection system," in the context of stably transformed cell lines, refers to a method for identifying and/or selecting cells containing a recombinant nucleic acid of interest. A large variety of selection systems are known for identification of transformed cells and are suitable for use with the present invention. For example, cells transformed by plasmids or other vectors can be selected by resistance to antibiotics conferred by genes contained on the plasmids, such as the well known amp, gpt, neo and hyg genes, or other genes such as the herpes simplex virus thymidine kinase (Wigler et al., Cell 11:223-32 [1977]) and adenine phosphoribosyltransferase (Lowy et al., Cell 22:817 [1980]) genes which can be employed in tk- or aprt-cells, respectively. Also, antimetabolite, antibiotic or herbicide resistance can be used as the basis for selection; for example, dhfr which confers resistance to methotrexate and is also useful for gene amplification (Wigler et al., *Proc. Natl. Acad. Sci.*, 77:3567 [1980]); npt, which confers resistance to the aminoglycosides neomycin and G-418 (Colbere-Garapin et al., *J. Mol. Biol.*, 150:1 [1981]) and als or pat, which confer resistance to chlorsulfuron and phosphinotricin acetyltransferase, respectively (Murry, in McGraw Hill Yearbook of Science and Technology, McGraw Hill, New York N.Y., pp 191-196, [1992]). Additional selectable genes have been described, for example, hygromycin resistance-conferring genes, trpB, which allows cells to utilize indole in place of tryptophan, or hisD, which allows cells to utilize histinol in place of histidine (Hartman and Mulligan, *Proc. Natl. Acad. Sci.*, 85:8047 [1988]). Recently, the use of visible markers has gained popularity with such markers as anthocyanins, beta-glucuronidase and its substrate, GUS, and luciferase and its substrate, luciferin, being widely used not only to identify transformants, but also to quantify the amount of transient or stable protein expression attributable to a specific vector system (Rhodes et al., *Meth. Mol. Biol.*, 55:121 [1995]).

As used herein, the "sequence" of a gene (unless specifically stated otherwise), nucleic acid, protein, or peptide refers to the order of nucleotides in either or both strands of a double-stranded DNA molecule, e.g., the sequence of both the coding strand and its complement, or of a single-stranded nucleic acid molecule, or to the order of amino acids in a peptide or protein.

As used herein, "specific binding" refers to the ability of one molecule, typically an antibody or polynucleotide, to contact and associate with another specific molecule even in the presence of many other diverse molecules. For example, a single-stranded polynucleotide can specifically bind to a single-stranded polynucleotide that is complementary in sequence, and an antibody specifically binds to (or "is specifically immunoreactive with") its corresponding antigen.

As used herein, "stringent hybridization conditions" or "stringency" refers to conditions in a range from about 5° C. to about 20° C. or 25° C. below the melting temperature ($T_m$) of the target sequence and a probe with exact or nearly exact complementarity to the target. As used herein, the melting temperature is the temperature at which a population of double-stranded nucleic acid molecules becomes half-dissociated into single strands. Methods for calculating the $T_m$ of nucleic acids are well known in the art (see, e.g., Berger and Kimmel (1987) METHODS IN ENZYMOLOGY, VOL. 152: GUIDE TO MOLECULAR CLONING TECHNIQUES, San Diego: Academic Press, Inc. and Sambrook et al. (1989) MOLECULAR CLONING: A LABORATORY MANUAL, 2ND ED., VOLS. 1-3, Cold Spring Harbor Laboratory hereinafter, "Sambrook"), both incorporated herein by reference). As indicated by standard references, a simple estimate of the $T_m$ value may be calculated by the equation: $T_m=81.5+0.41(\% \text{ G+C})$, when a nucleic acid is in aqueous solution at 1 M NaCl (see e.g., Anderson and Young, *Quantitative Filter Hybridization* in NUCLEIC ACID HYBRIDIZATION (1985)). Other references include more sophisticated computations which take structural as well as sequence characteristics into account for the calculation of $T_m$. The melting temperature of a hybrid (and thus the conditions for stringent hybridization) is affected by various factors such as the length and nature (DNA, RNA, base composition) of the probe and nature of the target (DNA, RNA, base composition, present in solution or immobilized, and the like), and the concentration of salts and other components (e.g., the presence or absence of formamide, dextran sulfate, polyethylene glycol). The effects of these factors are well known and are discussed in standard references in the art, e.g., Sambrook, supra and Ausubel et al. supra. Typically, stringent hybridization conditions are salt concentrations less than about 1.0 M sodium ion, typically about 0.01 to 1.0 M sodium ion at pH 7.0 to 8.3, and temperatures at least about 30° C. for short probes (e.g., 10 to 50 nucleotides) and at least about 60° C. for long probes (e.g., greater than 50 nucleotides). As noted, stringent conditions may also be achieved with the addition of destabilizing agents such as formamide, in which case lower temperatures may be employed.

As used herein, the term "substantial identity," "substantial sequence identity," or "substantial similarity" in the context of nucleic acids, refers to a measure of sequence similarity between two polynucleotides. Substantial sequence identity can be determined by hybridization under stringent conditions, by direct comparison, or other means. For example, two polynucleotides can be identified as having substantial sequence identity if they are capable of specifically hybridizing to each other under stringent hybridization conditions. Other degrees of sequence identity (e.g., less than "substantial") can be characterized by hybridization under different conditions of stringency. Alternatively, substantial sequence identity can be described as a percentage identity between two nucleotide (or polypeptide) sequences. Two sequences are considered substantially identical when they are at least about 60% identical, preferably at least about 70% identical, or at least about 80% identical, or at least about 90% identical, or at least about 95% or 98% to 100% identical. Percentage sequence (nucleotide or amino acid) identity is typically calculated by determining the optimal alignment between two sequences and comparing the two sequences. For example an exogenous transcript used for protein expression can be described as having a certain percentage of identity or similarity compared to a reference sequence (e.g., the corresponding endogenous sequence). Optimal alignment of sequences may be conducted using the local homology algorithm of Smith and Waterman (1981) *Adv. Appl. Math.* 2: 482, by the homology alignment algorithm of Needleman and Wunsch (1970) *J. Mol. Biol.* 48: 443, by the search for similarity method of Pearson and Lipman (1988) *Proc. Natl. Acad. Sci. U.S.A.* 85: 2444, by computerized implementations of these algorithms (GAP, BESTFIT, FASTA, and TFASTA in the Wisconsin Genetics Software Package, Genetics Computer Group, 575 Science Dr., Madison, Wis.), or by inspection. The best alignment (i.e., resulting in the highest percentage of identity) generated by the various methods is selected. Typically these algorithms compare the two sequences over a "comparison window" (usually at least 18 nucleotides in length) to identify and compare local regions of sequence similarity, thus allowing for small additions or deletions (i.e., gaps). Additions and deletions are typically 20 percent or less of the length of the sequence relative to the reference sequence, which does not comprise additions or deletions. It is sometimes desirable to describe sequence identity in reference to a particular length or region (e.g., two sequences may be described as having at least 95% identity over a length of at least 500 basepairs). Usually the length will be at least about 50, 100, 200, 300, 400 or 500 basepairs, amino acids, or other residues. The percentage of sequence identity is calculated by comparing two optimally aligned sequences over the region of comparison, determining the number of positions at which the identical nucleic acid base (e.g., A, T, C, G, or U) occurs in both sequences to yield the number of matched positions, and determining the number (or percentage) of matched positions as compared to the total number of bases in the reference sequence or region of comparison. An additional algorithm that is suitable for determining sequence similarity is the BLAST algorithm, which is described in Altschul (1990) *J. Mol. Biol.* 215: 403-410; and Shpaer (1996) *Genomics* 38:179-191. Software for performing BLAST analyses is publicly available at the National Center for Biotechnology Information (http://www.ncbi.nlm.nih.gov/). This algorithm involves first identifying high scoring sequence pairs (HSPs) by identifying short words of length W in the query sequence that either match or satisfy some positive-valued threshold score T when aligned with a word of the same length in a database sequence. T is referred to as the neighborhood word score threshold (Altschul et al, supra.). These initial neighborhood word hits act as seeds for initiating searches to find longer HSPs containing them. The word hits are extended in both directions along each sequence for as far as the cumulative alignment score can be increased. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLAST program uses as defaults a wordlength (W) of 11, the BLOSUM62 scoring matrix (see Henikoff(1992) *Proc. Natl. Acad. Sci. USA* 89: 10915-10919) alignments (B) of 50, expectation (E) of 10, M=5, N=-4, and a comparison of both strands. The term BLAST refers to the BLAST algorithm which performs a statistical analysis of the similarity between two sequences; see, e.g., Karlin (1993) *Proc. Natl. Acad. Sci. USA* 90:5873-5787. One measure of similarity provided by the BLAST algorithm is the smallest sum probability (P(N)), which provides an indication of the probability by which a match between two nucleotide or amino acid sequences would occur by chance. For example, a nucleic acid can be considered similar to a TRT nucleic acid if the smallest sum probability in a comparison of the test nucleic acid to an TRT nucleic acid is less than about 0.5, 0.2, 0.1, 0.01, or 0.001. Alternatively, another indication that two nucleic acid sequences are similar is that the polypeptide which the first nucleic acid encodes is immunologically cross reactive with the polypeptide encoded by the second nucleic acid. It will be recognized that homologous non-human TRT polynucleotides may have less that "substantial" nucleotide identity in certain regions, as the term "substantial identity" is defined herein. For example, *Euplotes* TRT is substantially less than about 60% identical to the hTRT polynucleotide of SEQ ID NO:1 in certain regions, although the two genes are homologs.

As used herein, the terms "substantial identity," "substantial sequence identity," or "substantial similarity" in the context of a polypeptide, refers to a degree of similarity between two polypeptides in which a polypeptides comprises a sequence with at least 70% sequence identity to a reference sequence, or 80%, or 85% or up to 100% sequence identity to the reference sequence, or most preferably 90% identity over a comparison window of about 10-20 amino acid residues. Amino acid sequence similarity, or sequence identity, is determined by optimizing residue matches, if necessary, by introducing gaps as required. See Needleham et al. (1970) J. Mol. Biol. 48: 443-453; and Sankoff et al., 1983, *Time Warps, String Edits, and Macromolecules, The Theory and Practice of Sequence Comparison*, Chapter One, Addison-Wesley; Reading, Mass.; and software packages from IntelliGenetics, Mountain View, Calif., and the University of Wisconsin Genetics Computer Group, Madison, Wis. As will be apparent to one of skill, the terms "substantial identity", "substantial similarity" and "substantial sequence identity" can be used interchangeably with regard to polypeptides or polynucleotides. It will be recognized that homologous non-human TRT polypeptides may have less that "substantial" sequence identity in certain regions, as the term "substantial identity" is defined herein. For example, *Euplotes* TRT protein is substantially less than about 60% identical to the hTRT polynucleotide of SEQ ID NO:2 in certain regions, although the two genes are homologs. In the context of TRT polypeptides from different species, for example, "significant homology" at the amino acid sequence means at least about 20% sequence identity in region of about 20 to about 40 residues, or at least about 40% sequence identity in region of at least about 20% sequence identity.

As used herein, the term "substantially pure," or "substantially purified," when referring to a composition comprising a specified reagent, such as an antibody (e.g. an anti-hTRT antibody), means that the specified reagent is at least about 75%, or at least about 90%, or at least about 95%, or at least about 99% or more of the composition (not including, e.g., solvent or buffer). Thus, for example, a preferred immunoglobulin preparation of the invention that specifically binds an hTRT polypeptide is substantially purified.

As used herein, a "telomerase negative" cell is one in which telomerase is not expressed, i.e., no telomerase catalytic activity can be detected using a conventional assay or a TRAP assay for telomerase catalytic activity. As used herein, a "telomerase positive" cell is a cell in which telomerase is expressed (i.e. telomerase activity can be detected).

As used herein, a "telomerase-related" disease or condition is a disease or condition in a subject that is correlated with an abnormally high level of telomerase activity in cells of the individual, which can include any telomerase activity at all for most normal somatic cells, or which is correlated with a low level of telomerase activity that results in impairment of a normal cell function. Examples of telomerase-related conditions include, e.g., cancer (high telomerase activity in malignant cells) and infertility (low telomerase activity in germ-line cells).

As used herein, "test compound" or "agent" refers to any synthetic or natural compound or composition. The term includes all organic and inorganic compounds; including, for example, small molecules, peptides, proteins, sugars, nucleic acids, fatty acids and the like.

XIII. EXAMPLES

The following examples are provided to illustrate the present invention, and not by way of limitation.

In the following sections, the following abbreviations apply: eq (equivalents); M (Molar); µM (micromolar); N (Normal); mol (moles); mmol (millimoles); µmol (micromoles); nmol (nanomoles); g (grams); mg (milligrams); µg (micrograms); ng (nanograms); l or L (liters); ml (milliliters); µl (microliters); cm (centimeters); mm (millimeters); µm (micrometers); nm (nanometers); ° C. (degrees Centigrade); RPN (ribonucleoprotein); mreN (2'-O-methylribonucleotides); dNTP (deoxyribonucleotide); dH$_2$O (distilled water); DDT (dithiothreitol); PMSF (phenylmethylsulfonyl fluoride); TE (10 mM Tris HCl, 1 mM EDTA, approximately pH 7.2); KGlu (potassium glutamate); SSC (salt and sodium citrate buffer); SDS (sodium dodecyl sulfate); PAGE (polyacrylamide gel electrophoresis); Novex (Novex, San Diego, Calif.); BioRad (Bio-Rad Laboratories, Hercules, Calif.); Pharmacia (Pharmacia Biotech, Piscataway, N.J.); Boehringer-Mannheim (Boehringer-Mannheim Corp., Concord, Calif.); Amersham (Amersham, Inc., Chicago, Ill.); Stratagene (Stratagene Cloning Systems, La Jolla, Calif.); NEB (New England Biolabs, Beverly, Mass.); Pierce (Pierce Chemical Co., Rockford, Ill.); Beckman (Beckman Instruments, Fullerton, Calif.); Lab Industries (Lab Industries, Inc., Berkeley, Calif.); Eppendorf (Eppendorf Scientific, Madison, Wis.); and Molecular Dynamics (Molecular Dynamics, Sunnyvale, Calif.).

Example 1

Isolation of Telomerase Proteins and Clones

The following example details the isolation of telomerase proteins and clones from various organisms, including the *euplotes* p. 123, hTRT, TRT and *S. pombe* TRT telomerase cDNA clones.

A. Background
i) Introduction

This section provides an overview of the purification and cloning of TRT genes, which is described in greater detail in subsequent sections of this Example. While telomerase RNA subunits have been identified in ciliates, yeast and mammals, protein subunits of the enzyme have not been identified as such prior to the present invention. Purification of telomerase from the ciliated protozoan *Euplotes aediculatus* yielded two proteins, termed p123 and p43 (see infra; Lingner (1996) *Proc. Natl. Acad. Sci. U.S.A.* 93:10712). *Euplotes aediculatus* is a hypotrichous ciliate having a macronucleus containing about 8×10$^7$ telomeres and about 3×10$^5$ molecules of telomerase. After purification, the active telomerase complex had a molecular mass of about 230 kD, corresponding to a 66 kD RNA subunit and two proteins of about 123 kD and 43 kD (Lingner (1996) supra). Photo-cross-linking experiments indicated that the larger p123 protein was involved in specific binding of the telomeric DNA substrate (Lingner, (1996) supra).

The p123 and p43 proteins were sequenced and the cDNA clones which encoded these proteins were isolated. These *Euplotes* sequences were found to be unrelated to the *Tetrahymena* telomerase-associated proteins p80 and p95. Sequence analysis of the *Euplotes* p123 revealed reverse transcriptase (RT) motifs. Furthermore, sequence analysis of the *Euplotes* p123 by comparison to other sequences revealed a yeast homolog, termed Est2 protein (Lingner (1997) *Science* 276:561). Yeast Est2 had previously been shown to be essential for telomere maintenance in vivo (Lendvay (1996) *Genetics* 144:1399) but had not been identified as a telomerase catalytic protein. Site-specific mutagenesis demonstrated that the RT motifs of yeast Est2 are essential for telomeric DNA synthesis in vivo and in vitro (Lingner (1997) supra).

ii) Identifying and Characterizing *S. pombe* Telomerase

PCR amplification of *S. pombe* DNA was carried out with degenerate sequence primers designed from the *Euplotes* p123 RT motifs as described below. Of the four prominent PCR products generated, a 120 base pair band encoded a peptide sequence homologous to p123 and Est2. This PCR product was used as a probe in colony hybridization and identified two overlapping clones from an *S. pombe* genomic library and three from an *S. pombe* cDNA library. Sequence analysis revealed that none of the three *S. pombe* cDNA clones was full length, so RT-PCR was used to obtain the sequences encoding the protein's N-terminus.

Complete sequencing of these clones revealed a putative *S. pombe* telomerase RT gene, trt1. The complete nucleotide sequence of trt1 has been deposited in GenBank, accession number AF015783 (see FIG. 15).

To test *S. pombe* trt1 (as a catalytic subunit, two deletion constructs were created. Analysis of the sequence showed that trt1 encoded a basic protein with a predicted molecular mass of 116 kD. It was found that homology with p123 and Est2 was especially high in the seven reverse transcriptase motifs, underlined and designated as motifs 1, 2, A, B, C, D, and E (see FIG. 63). An additional telomerase-specific motif, designated the T-motif, was also found. Fifteen introns, ranging in size from 36 to 71 base pairs, interrupted the coding sequence.

To test *S. pombe* trt1 as a catalytic subunit, two deletion constructs were created. One removed only motifs B through D in the RT domains. The second removed 99% of the open reading frame.

Haploid cells grown from *S. pombe* spores of both mutants showed progressive telomere shortening to the point where hybridization to telomeric repeats became almost undetectable. A trt1$^+$/trt1$^-$ diploid was sporulated and the resulting tetrads were dissected and germinated on a yeast extract medium supplemented with amino acids (a YES plate, Alfa (1993) *Experiments with Fission Yeast*, Cold Spring Harbor Laboratory Press, Cold Spring Harbor, N.Y.). Colonies derived from each spore were grown at 32° C. for three days, and streaked successively to fresh YES plates every three days. A colony from each round was placed in six ml of YES liquid culture at 32° C. and grown to stationary phase. Genomic DNA was prepared. After digestion with ApaI, DNA was subjected to electrophoresis on a 2.3% agarose gel, stained with ethidium bromide to confirm approximately equal loading in each lane, then transferred to a nylon membrane and hybridized to a telomeric DNA probe.

Figure 22:
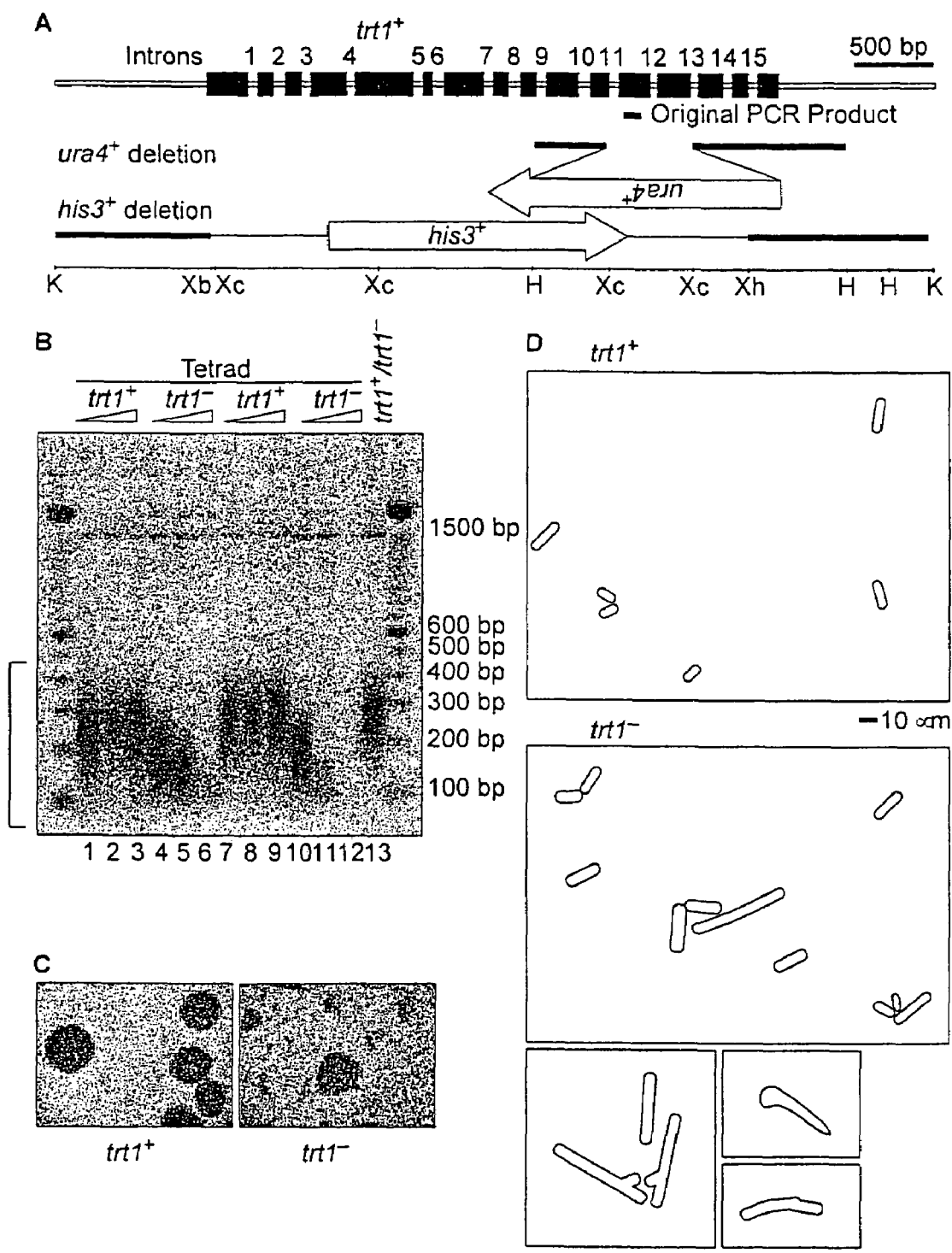
FIG. 22 shows the effect of mutation of the TRT gene in yeast, as described in Example 1.

Senescence was indicated by the delayed onset of growth or failure to grow on agar (typically at the fourth streak-out after germination) and by colonies with increasingly ragged edges (colony morphology shown in FIG. 22C) and by increasingly high fractions of elongated cells (as shown in FIG. 22D). Cells were plated on Minimal Medium (Alfa (1993) supra) with glutamic acid substituted for ammonium chloride for two days at 32° C. prior to photography.

When individual enlarged cells were separated on the dissecting microscope, the majority were found to undergo no further division. The same telomerase negative (trt1$^-$) cell population always contained normal-sized cells which continued to divide, but which frequently produced non-dividing progeny. The telomerase-negative survivors may use a recombinational mode of telomere maintenance as documented in budding yeast strains that have various telomere-replication genes deleted (Lendvay (1996) supra, Lundblad (1993) *Cell* 73:347).

iii) Identifying and Characterizing Human Telomerase

An EST (expressed sequence tag) derived from human telomerase reverse transcriptase (hTRT) cDNA was identified by a BLAST search of the dbEST (expressed sequence tag) Genbank database using the *Euplotes* 123 kDa peptide and nucleic acid sequences, as well as the *Schizosaccharomyces* protein and corresponding cDNA (tez1) sequences. The EST, designated Genbank AA28196, is 389 nucleotides long and it corresponds to positions 1679 to 2076 of clone 712562 (FIG. 18), was obtained from the I.M.A.G.E. Consortium (Human Genome Center, DOE, Lawrence Livermore National Laboratory, Livermore, Calif.). This clone was obtained from a cDNA library of germinal B cells derived by flow sorting of tonsil cells. Complete sequencing of this hTRT cDNA clone showed all eight telomerase RT (TRT) motifs. However, this hTRT clone did not encode a contiguous portion of a TRT because RT motifs B', C, D, and E, were contained in a different open reading frame than the more N-terminal RT motifs. In addition, the distance between RT motifs A and B was substantially shorter than that of the three previously known (non-human) TRTs.

To isolate a full length cDNA clone, a cDNA library derived form the human 293 cell line (described above) which expresses high levels of telomerase activity, was screened. A lambda cDNA library from the 293 cell line was partitioned into 25 pools containing about 200,000 plaques each. Each pool was screened by PCR with the primer pair 5'-CGGAAGAGTGTCTGGAGCAA-3' (SEQ ID NO:551) and 5'-GGATGAAGCGGAGTCTGGA-3' (SEQ ID NO:459). Six subpools of one positive primary pool were further screened by PCR using this same primer pair. For both the primary and the secondary subpool screening, hTRT was amplified for a total of 31 cycles at: 94° C., 45 seconds; 60° C., 45 seconds; and 72° C., 90 seconds. As a control, RNA of the house-keeping enzyme GAPDH was amplified using the primer pair 5'-CTCAGACACCATGGG-GAAGGTGA-3' (SEQ ID NO:552) and 5'-ATGATCT-TGAGGCTGTTGTCATA-3' (SEQ ID NO:553) for a total of 16 cycles at 94° C., 45 seconds; 55° C., 45 seconds; and 72° C., 90 seconds.

One hTRT positive subpool from the secondary screening was then screened by plaque hybridization with a probe from the 5' region of the clone #712562. One phage was positively identified (designated Lambda phage 25-1.1, ATCC 209024, deposited May 12, 1997). It contained an approximately four kilobase insert, which was excised and subcloned into the EcoRI site of pBluescript II SK+ vector (Stratagene, San Diego, Calif.) as an EcoRI fragment. This cDNA clone-containing plasmid was designated pGRN121. The cDNA insert totals approximately 4 kilobasepairs. The complete nucleotide sequence of the human hTRT cDNA (pGRN121) has been deposited in Genbank (accession AF015950) and the plasmid has been deposited with the ATCC (ATCC 209016, deposited May 6, 1997).

B. Growth of *Euplotes aediculatus*

In this Example, cultures of *E. aediculatus* were obtained from Dr. David Prescott, MCDB, University of Colorado. Dr. Prescott originally isolated this culture from pond water, although this organism is also available from the ATCC (ATCC #30859). Cultures were grown as described by Swanton et al., (Swanton et al., Chromosoma 77:203 [1980]), under non-sterile conditions, in 15-liter glass containers containing *Chlorogonium* as a food source. Organisms were harvested from the cultures when the density reached approximately $10^4$ cells/ml.

C. Preparation of Nuclear Extracts

In this Example, nuclear extracts of *E. aediculatus* were prepared using the method of Lingner et al., (Lingner et al., Genes Develop., 8:1984 [1994]), with minor modifications, as indicated below. Briefly, cells grown as described in Part B were concentrated with 15 μm Nytex filters and cooled on ice. The cell pellet was resuspended in a final volume of 110 ml TMS/PMSF/spermidine phosphate buffer. The stock TMS/PMSF/spermidine phosphate buffer was prepared by adding 0.075 g spermidine phosphate (USB) and 0.75 ml PMSF (from 100 mM stock prepared in ethanol) to 150 ml TMS. TMS comprised 10 mM Tris-acetate, 10 mM $MgCl_2$, 85.5752 g sucrose/liter, and 0.33297 g $CaCl_2$/liter, pH 7.5.

After resuspension in TMS/PMSF/spermidine phosphate buffer, 8.8 ml 10% NP-40 and 94.1 g sucrose were added and the mixture placed in a siliconized glass beaker with a stainless steel stirring rod attached to an overhead motor. The mixture was stirred until the cells were completely lysed (approximately 20 minutes). The mixture was then centrifuged for 10 minutes at 7500 rpm (8950×g), at 4EC, using a Beckman JS-13 swing-out rotor. The supernatant was removed and nuclei pellet was resuspended in TMS/PMSF/spermidine phosphate buffer, and centrifuged again, for 5 minutes at 7500 rpm (8950×g), at 4EC, using a Beckman JS-13 swing-out rotor.

The supernatant was removed and the nuclei pellet was resuspended in a buffer comprised of 50 mM Tris-acetate, 10 mM $MgCl_2$, 10% glycerol, 0.1% NP-40, 0.4 M KGlu, 0.5 mM PMSF, pH 7.5, at a volume of 0.5 ml buffer per 10 g of harvested cells. The resuspended nuclei were then dounced in a glass homogenizer with approximately 50 strokes, and then centrifuged for 25 minutes at 14,000 rpm at 4° C., in an Eppendorf centrifuge. The supernatant containing the nuclear extract was collected, frozen in liquid nitrogen, and stored at −80° C. until used.

D. Purification of Telomerase

In this Example, nuclear extracts prepared as described in Part C were used to purify *E. aediculatus* telomerase. In this purification protocol, telomerase was first enriched by chromatography on an Affi-Gel-heparin column, and then extensively purified by affinity purification with an antisense oligonucleotide. As the template region of telomerase RNA is accessible to hybridization in the telomerase RNP particle, an antisense oligonucleotide (i.e., the "affinity oligonucleotide") was synthesized that was complementary to this template region as an affinity bait for the telomerase. A biotin residue was included at the 5' end of the oligonucleotide to immobilize it to an avidin column.

Following the binding of the telomerase to the oligonucleotide, and extensive washing, the telomerase was eluted by use of a displacement oligonucleotide. The affinity oligonucleotide included DNA bases that were not complementary to the telomerase RNA 5' to the telomerase-specific sequence. As the displacement oligonucleotide was complementary to the affinity oligonucleotide for its entire length, it was able to form a more thermodynamically stable duplex than the telomerase bound to the affinity oligonucleotide. Thus, addition of the displacement oligonucleotide resulted in the elution of the telomerase from the column.

The nuclear extracts prepared from 45 liter cultures were frozen until a total of 34 ml of nuclear extract was collected. This corresponded to 630 liters of culture (i.e., approximately $4\times10^9$ cells). The nuclear extract was diluted with a buffer to 410 ml, to provide final concentrations of 20 mM Tris-acetate, 1 mM $MgCl_2$, 0.1 mM EDTA, 33 mM KGlu, 10% (vol/vol) glycerol, 1 mM dithiothreitol (DTT), and 0.5 mM phenylmethylsulfonyl fluoride (PMSF), at a pH of 7.5.

The diluted nuclear extract was applied to an Affi-Gel-heparin gel column (Bio-Rad), with a 230 ml bed volume and 5 cm diameter, equilibrated in the same buffer and eluted with a 2-liter gradient from 33 to 450 mM KGlu. The column was run at 4° C., at a flow rate of 1 column volume/hour. Fractions of 50 mls each were collected and assayed for telomerase activity as described in Part E. Telomerase was eluted from the column at approximately 170 mM KGlu. Fractions containing telomerase (approximately 440 ml) were pooled and adjusted to 20 mM Tris-acetate, 10 mM $MgCl_2$, 1 mM EDTA, 300 mM KGlu, 10% glycerol, 1 mM DTT, and 1% Nonidet P-40. This buffer was designated as "WB."

To this preparation, 1.5 nmol of each of two competitor DNA oligonucleotides (5'-TAGACCTGTTAGTGTA-CATTTGAATTGAAGC-3'; SEQ ID NO:554 and 5'-TAGACCTGTTAGGTTGGATTTGTGGCATCA-3'; SEQ ID NO:552), 50 μg yeast RNA (Sigma), and 0.3 nmol of biotin-labeled telomerase-specific oligonucleotide (5'-biotin-TAGACCTGTTA-(rmeG)$_2$-(rmeU)$_4$-(rmeG)$_4$-(rmeU)$_4$-rmeG-3'; SEQ ID NO:556), were added per ml of the pool. The 2-O-methylribonucleotides of the telomerase specific oligonucleotides were complementary to the telomerase RNA; template region; the deoxyribonucleotides were not complementary. The inclusion of competitor, non-specific DNA oligonucleotides increased the efficiency of the purification, as the effects of nucleic acid binding proteins and other components in the mixture that would either bind to the affinity oligonucleotide or remove the telomerase from the mixture were minimized.

This material was then added to Ultralink immobilized neutravidin plus (Pierce) column material, at a volume of 60 μl of suspension per ml of pool. The column material was pre-blocked twice for 15 minutes each blocking, with a preparation of WB containing 0.01% Nonidet P-40, 0.5 mg BSA, 0.5 mg/ml lysozyme, 0.05 mg/ml glycogen, and 0.1 mg/ml yeast RNA. The blocking was conducted at 4° C., using a rotating wheel to block the column material thoroughly. After the first blocking step, and before the second blocking step, the column material was centrifuged at 200×g for 2 minutes to pellet the matrix.

The pool-column mixture was incubated for 8 minutes at 30° C., and then for an additional 2 hours at 4E° C., on a rotating wheel (approximately 10 rpm; Labindustries) to allow binding. The pool-column mixture was then centrifuged 200×g for 2 minutes, and the supernatant containing unbound material was removed. The pool-column mixture was then washed. This washing process included the steps of rinsing the pool-column mixture with WB at 4° C., washing the mixture for 15 minutes with WB at 4° C., rinsing with WB, washing for 5 minutes at 30° C., with WB containing 0.6 M KGlu, and no Nonidet P-40, washing 5 minutes at 25° C. with WB, and finally, rinsing again with WB. The volume remaining after the final wash was kept small, in order to yield a ratio of buffer to column material of approximately 1:1.

Telomerase was eluted from the column material by adding 1 nmol of displacement deoxyoligonucleotide (5'-CA$_4$C$_4$A$_4$C$_2$TA$_2$CAG$_2$TCTA-3'; SEQ ID NO:557), per ml of column material and incubating at 25° C. for 30 minutes. The material was centrifuged for 2 minutes at 14,000 rpm in a microcentrifuge (Eppendorf), and the eluate collected. The elution procedure was repeated twice more, using fresh displacement oligonucleotide each time. As mentioned above, because the displacement oligonucleotide was complementary to the affinity oligonucleotide, it formed a more thermodynamically stable complex with the affinity oligonucleotide than P-40. Thus, addition of the displacement oligonucleotide to an affinity-bound telomerase resulted in efficient elution of telomerase under native conditions. The telomerase appeared to be approximately 50% pure at this stage, as judged by analysis on a protein gel. The affinity purification of telomerase and elution with a displacement oligonucleotide is shown in FIG. 26 (panels A and B, respectively). In this Figure, the 2'-O-methyl sugars of the affinity oligonucleotide are indicated by the bold line. The black and shaded oval shapes in this figure are intended to represent graphically the protein subunits of the present invention.

The protein concentrations of the extract and material obtained following Affi-Gel-heparin column chromatography were determined using the method of Bradford (Bradford, Anal. Biochem., 72:248 [1976]), using BSA as the standard. Only a fraction of the telomerase preparation was further purified on a glycerol gradient.

The sedimentation coefficient of telomerase was determined by glycerol gradient centrifugation, as described in Part I.

Table 5 below is a purification table for telomerase purified according to the methods of this Example. The telomerase was enriched 12-fold in nuclear extracts, as compared to whole cell extracts, with a recovery of 80%; 85% of telomerase was solubilized from nuclei upon extraction.

TABLE 5

Purification of Telomerase

| Fraction | Protein (mg) | Telomerase (pmol of RNP) | Telomerase/ Protein/ pmol of RNP/ mg | Recovery (%) | Purification Factor |
|---|---|---|---|---|---|
| Nuclear Extract | 2020 | 1720 | 0.9 | 100 | 1 |
| Heparin | 125 | 1040 | 8.3 | 60 | 10 |
| Affinity | 0.3** | 680 | 2270 | 40 | 2670 |
| Glycerol Gradient | NA* | NA* | NA* | 25 | NA* |

*NA = Not available
**This value was calculated from the measured amount of telomerase (680 pmol), by assuming a purity of 50% (based on a protein gel).

E. Telomerase Activity

At each step in the purification of telomerase, the preparation was analyzed by three separate assays, one of which was activity, as described in this Example. In general, telomerase assays were done in 40 µl containing 0.003-0.3 µl of nuclear extract, 50 mM Tris-Cl (pH 7.5), 50 mM KGlu, 10 mM MgCl$_2$, 1 mM DTT, 125 µM dTTP, 125 µM dGTP, and approximately 0.2 pmoles of 5'-$^{32}$P-labelled oligonucleotide substrate (i.e., approximately 400,000 cpm). Oligonucleotide primers were heat-denatured prior to their addition to the reaction mixture. Reactions were assembled on ice and incubated for 30 minutes at 25EC. The reactions were stopped by addition of 200 µl of 10 mM Tris-Cl (pH 7.5), 15 mM EDTA, 0.6% SDS, and 0.05 mg/ml proteinase K, and incubated for at least 30 minutes at 45EC. After ethanol precipitation, the products were analyzed on denaturing 8% PAGE gels, as known in the art (See e.g., Sambrook et al, 1989).

F. Quantitation of Telomerase Activity

In this Example, quantitation of telomerase activity through the purification procedure is described. Quantitation was accomplished by assaying the elongation of oligonucleotide primers in the presence of dGTP and [α-$^{32}$P]dTTP. Briefly, 1 µM 5'-(G$_4$T$_4$)$_2$-3' oligonucleotide was extended in a 20 µl reaction mixture in the presence of 2 µl of [α-$^{32}$P] dTTP (10 mCi/ml, 400 Ci/mmol; 1 Ci=37 GBq), and 125 µM dGTP as described (Lingner et al., Genes Develop., 8:1984 [1994]) and loaded onto an 8% PAGE sequencing gel as described.

Figure 28:
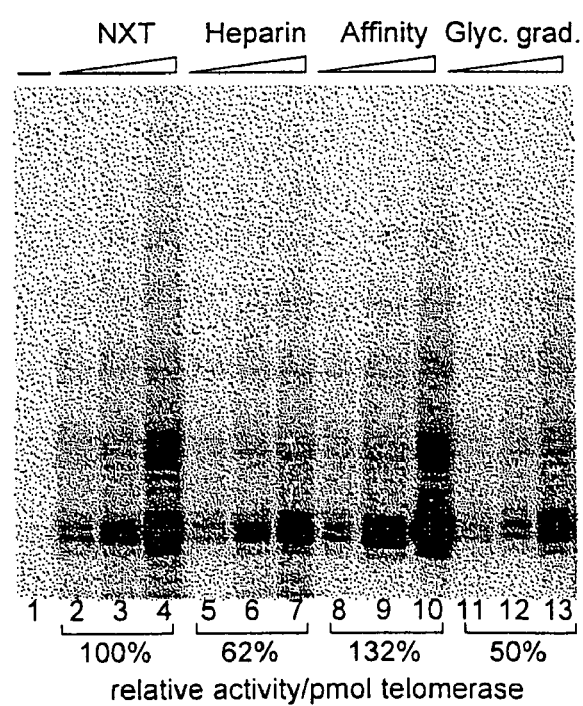
FIG. 28 shows telomerase activity through a purification protocol.

The results of this study are shown in FIG. 28. In lane 1, there is no telomerase present (i.e., a negative control); lanes 2, 5, 8, and 11 contained 0.14 fmol telomerase; lanes 3, 6, 9, and 12 contained 0.42 fmol telomerase; and lanes 4, 7, 10, and 13 contained 1.3 fmol telomerase. Activity was quantitation using a PhosphorImager (Molecular Dynamics) using the manufacturer's instructions. It was determined that under these conditions, 1 fmol of affinity-purified telomerase incorporated 21 fmol of dTTP in 30 minutes.

As shown in FIG. 28, the specific activity of the telomerase did not change significantly through the purification procedure. Affinity-purified telomerase was fully active. However, it was determined that at high concentrations, an inhibitory activity was detected and the activity of crude extracts was not linear. Thus, in the assay shown in FIG. 28, the crude extract was diluted 700-7000-fold. Upon purification, this inhibitory activity was removed and no inhibitory effect was detected in the purified telomerase preparations, even at high enzyme concentrations.

G. Gel Electrophoresis and Northern Blots

As stated in Part E, at each step in the purification of telomerase, the preparation was analyzed by three separate assays. This Example describes the gel electrophoresis and blotting procedures used to quantify telomerase RNA present in fractions and analyze the integrity of the telomerase ribonucleoprotein particle.

i) Denaturing Gels and Northern Blots

In this Example, synthetic T7-transcribed telomerase RNA of known concentration served as the standard. Throughout this investigation, the RNA component was used as a measure of telomerase.

A construct for phage T7 RNA polymerase transcription of *E. aediculatus* telomerase RNA was produced, using (PCR). The telomerase RNA gene was amplified with primers that annealed to either end of the gene. The primer that annealed at the 5' end also encoded a hammerhead ribozyme sequence to generate the natural 5' end upon cleavage of the transcribed RNA, a T7-promoter sequence, and an EcoRI site for subcloning. The sequence of this 5' primer was 5'-GCGGGAATTCTAA TACGACTCACTATAGGGAA-GAAACTCTGATGAGGCCGAAAGGC-CGAAACTCCAC GAAAGTGGAGTAAGTTTCTC-GATAATTGATCTGTAG-3' (SEQ ID NO:558). The 3' primer included an EarI site for termination of transcription at the natural 3' end, and a BamHI site for cloning. The sequence of this 3' primer was 5'-CGGGGATCCTCT-TCAAAAG ATGAGAGGACAGCAAAC-3'(SEQ ID NO:559). The PCR amplification product was cleaved with EcoRI and BamHI, and subcloned into the respective sites of pUC19 (NEB), to give "pEaT7." The correctness of this insert was confirmed by DNA sequencing. T7 transcription was performed as described by Zaug et al., Biochemistry 33:14935 [1994], with EarI-linearized plasmid. RNA was gel-purified and the concentration was determined (an A$_{260}$ of 1=40 µg/ml). This RNA was used as a standard to determine the telomerase RNA present in various preparations of telomerase.

The signal of hybridization was proportional to the amount of telomerase RNA, and the derived RNA concentrations were consistent with, but slightly higher than those obtained by native gel electrophoresis. Comparison of the amount of whole telomerase RNA in whole cell RNA to serial dilutions of known T7 RNA transcript concentrations indicated that each *E. aediculatus* cell contained approximately 300,000 telomerase molecules.

Visualization of the telomerase was accomplished by Northern blot hybridization to its RNA component, using methods as described (Linger et al., Genes Develop., 8:1984 [1994]). Briefly, RNA (less than or equal to 0.5 µg/lane) was resolved on an 8% PAGE and electroblotted onto a Hybond-N membrane (Amersham), as known in the art (see e.g., Sambrook et al., 1989). The blot was hybridized overnight in 10 ml of 4×SSC, 10× Denhardt's solution, 0.1% SDS, and 50 µg/ml denatured herring sperm DNA. After pre-hybridizing for 3 hours, $2 \times 10^6$ cpm probe/ml hybridization solution was added. The randomly labelled probe was a PCR-product that covered the entire telomerase RNA gene. The blot was washed with several buffer changes for 30 minutes in 2×SSC, 0.1% SDS, and then washed for 1 hour in 0.1×SSC and 0.1% SDS at 45° C.

ii) Native Gels and Northern Blots

In this experiment, the purified telomerase preparation was run on native (i.e., non-denaturing) gels of 3.5% polyacrylamide and 0.33% agarose, as known in the art and described (Lamond and Sproat, [1994], supra). The telomerase comigrated approximately with the xylene cyanol dye.

Figure 27:
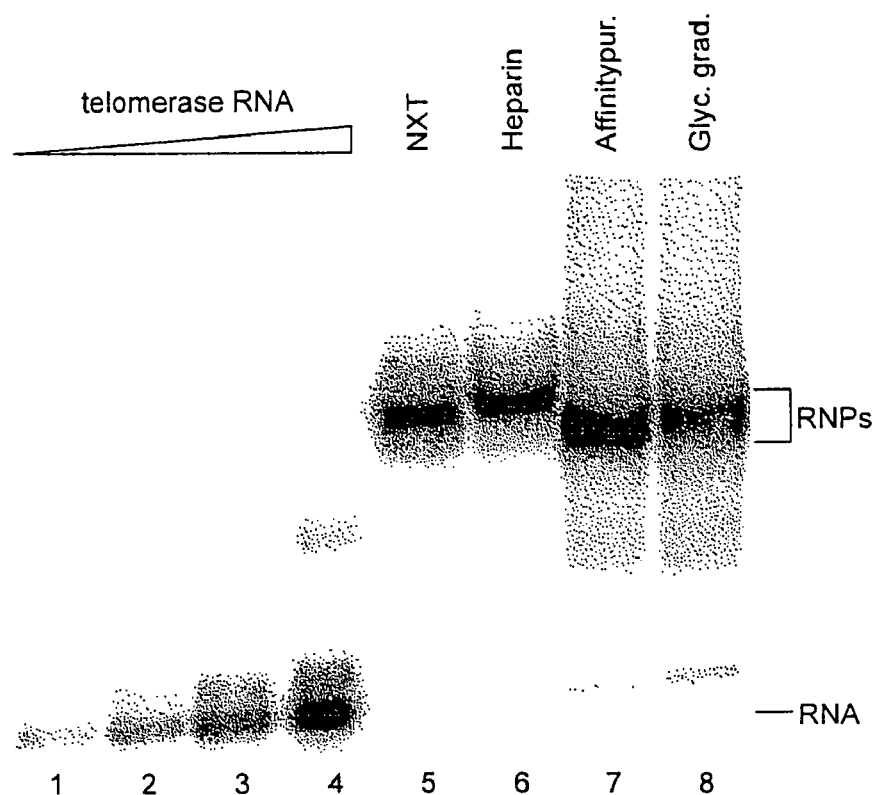
FIG. 27 is a photograph of a Northern blot of telomerase preparations obtained during a purification protocol, as described in Example 1. Lane 1 contained 1.5 fmol telomerase RNA, lane 2 contained 4.6 fmol telomerase RNA, lane 3 contained 14 fmol telomerase RNA, lane 4 contained 41 fmol telomerase RNA, lane 5 contained nuclear extract (42 fmol telomerase), lane 6 contained Affi-Gel-heparin-purified telomerase (47 fmol telomerase), lane 7 contained affinity-purified telomerase (68 fmol), and lane 8 contained glycerol gradient-purified telomerase (35 fmol).

The native gel results indicated that telomerase was maintained as an RNP throughout the purification protocol. FIG. 27 is a photograph of a Northern blot showing the mobility of the telomerase in different fractions on a non-denaturing gel as well as in vitro transcribed telomerase. In this figure, lane 1 contained 1.5 fmol telomerase RNA, lane 2 contained 4.6 fmol telomerase RNA, lane 3 contained 14 fmol telomerase RNA, lane 4 contained 41 fmol telomerase RNA, lane 5 contained nuclear extract (42 fmol telomerase), lane 6 contained Affi-Gel-heparin-purified telomerase (47 fmol telomerase), lane 7 contained affinity-purified telomerase (68 fmol), and lane 8 contained glycerol gradient-purified telomerase (35 fmol).

As shown in FIG. 27, in nuclear extracts, the telomerase was assembled into an RNP particle that migrated slower than unassembled telomerase RNA. Less than 1% free RNA was detected by this method. However, a slower migrating telomerase RNP complex was also sometimes detected in extracts. Upon purification on the Affi-Gel-heparin column, the telomerase RNP particle did not change in mobility (FIG. 27, lane 6). However, upon affinity purification the mobility of the RNA particle slightly increased (FIG. 27, lane 7), perhaps indicating that a protein subunit or fragment had been lost. On glycerol gradients, the affinity-purified telomerase did not change in size, but approximately 2% free telomerase RNA was detectable (FIG. 27, lane 8), suggesting that a small amount of disassembly of the RNP particle had occurred.

H. Telomerase Protein Composition

In this Example, the analysis of the purified telomerase protein composition are described.

Figure 29:
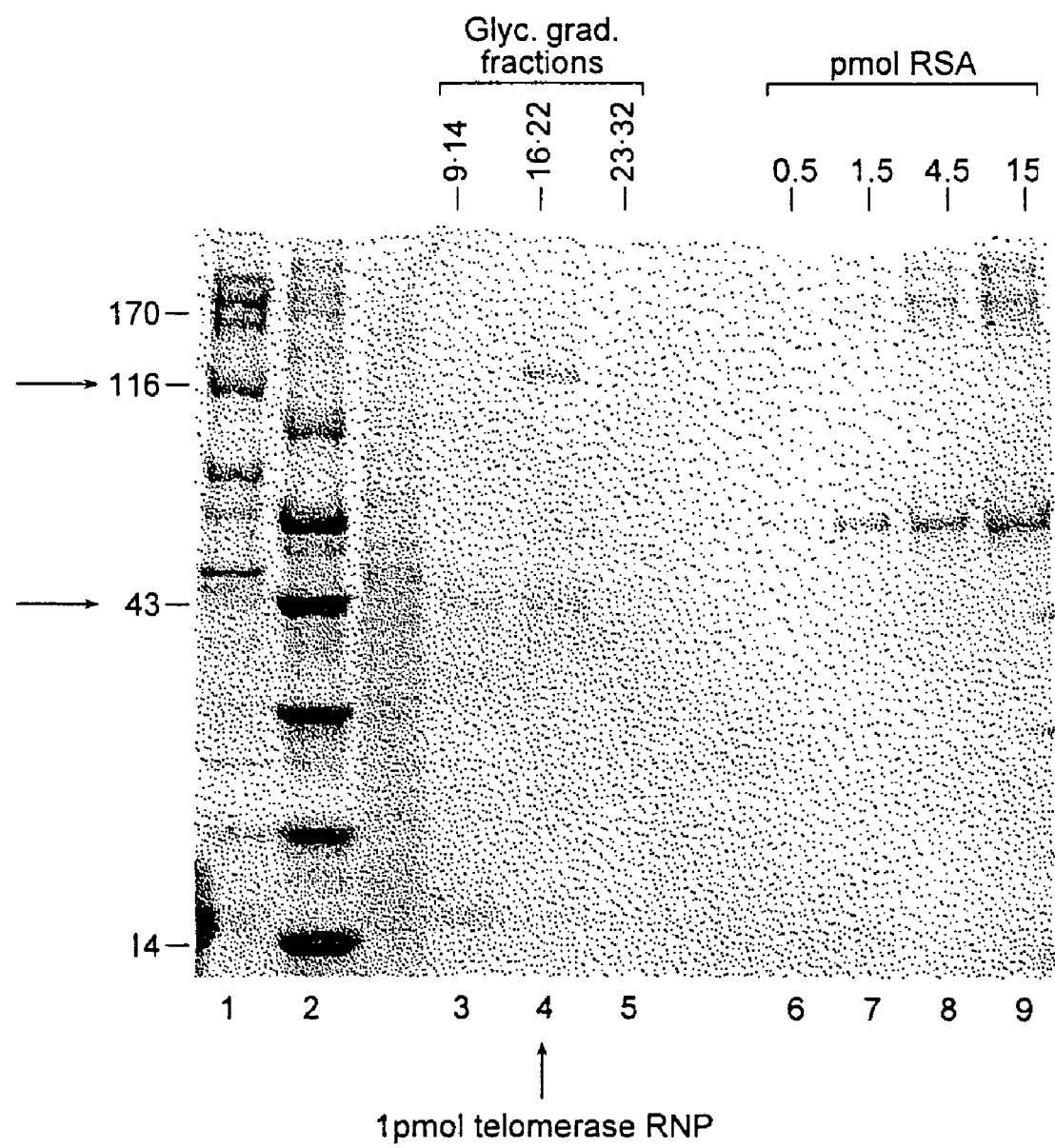
FIG. 29 is a photograph of a SDS-PAGE gel, showing the presence of an approximately 123 kDa polypeptide and an approximately 43 kDa doublet from *Euplotes aediculatus*.

Glycerol gradient fractions obtained as described in Part D, were separated on a 4-20% polyacrylamide gel (Novex). Following electrophoresis, the gel was stained with Coomassie brilliant blue. FIG. 29 shows a photograph of the gel. Lanes 1 and 2 contained molecular mass markers (Pharmacia) as indicated on the left side of the gel shown in FIG. 29. Lanes 3-5 contained glycerol gradient fraction pools as indicated on the top of the gel (i.e., lane 3 contained fractions 9-14, lane 4 contained fractions 15-22, and lane 5 contained fractions 23-32). Lane 4 contained the pool with 1 pmol of telomerase RNA. In lanes 6-9 BSA standards were run at concentrations indicated at the top of the gel in FIG. 29 (i.e., lane 6 contained 0.5 pmol BSA, lane 7 contained 1.5 pmol BSA, lane 8 contained 4.5 BSA, and lane 9 contained 15 pmol BSA).

As shown in FIG. 29, polypeptides with molecular masses of 120 and 43 kDa co-purified with the telomerase. The 43 kDa polypeptide was observed as a doublet. It was noted that the polypeptide of approximately 43 kDa in lane 3 migrated differently than the doublet in lane 4; it may be an unrelated protein. The 120 kDa and 43 kDa doublet each stained with Coomassie brilliant blue at approximately the level of 1 pmol, when compared with BSA standards. Because this fraction contained 1 pmol of telomerase RNA, all of which was assembled into an RNP particle (See, FIG. 27, lane 8), there appear to be two polypeptide subunits that are stoichiometric with the telomerase RNA. However, it is also possible that the two proteins around 43 kDa are separate enzyme subunits.

Affinity-purified telomerase that was not subjected to fractionation on a glycerol gradient contained additional polypeptides with apparent molecular masses of 35 and 37 kDa, respectively. This latter fraction was estimated to be at least 50% pure. However, the 35 kDa and 37 kDa polypeptides that were present in the affinity-purified material were not reproducibly separated by glycerol gradient centrifugation. These polypeptides may be contaminants, as they were not visible in all activity-containing preparations.

I. Sedimentation Coefficient

The sedimentation coefficient for telomerase was determined by glycerol gradient centrifugation. In this Example, nuclear extract and affinity-purified telomerase were fractionated on 15-40% glycerol gradients containing 20 mM Tris-acetate, with 1 mM $MgCl_2$, 0.1 mM EDTA, 300 mM KGlu, and 1 mM DTT, at pH 7.5. Glycerol gradients were poured in 5 ml (13×51 mm) tubes, and centrifuged using an SW55Ti rotor (Beckman) at 55,000 rpm for 14 hours at 4° C.

Marker proteins were run in a parallel gradient and had a sedimentation coefficient of 7.6 S for alcohol dehydrogenase (ADH), 113 S for catalase, 17.3 S for apoferritin, and 19.3 S for thyroglobulin. The telomerase peak was identified by native gel electrophoresis of gradient fractions followed by blot hybridization to its RNA component.

Figure 30:
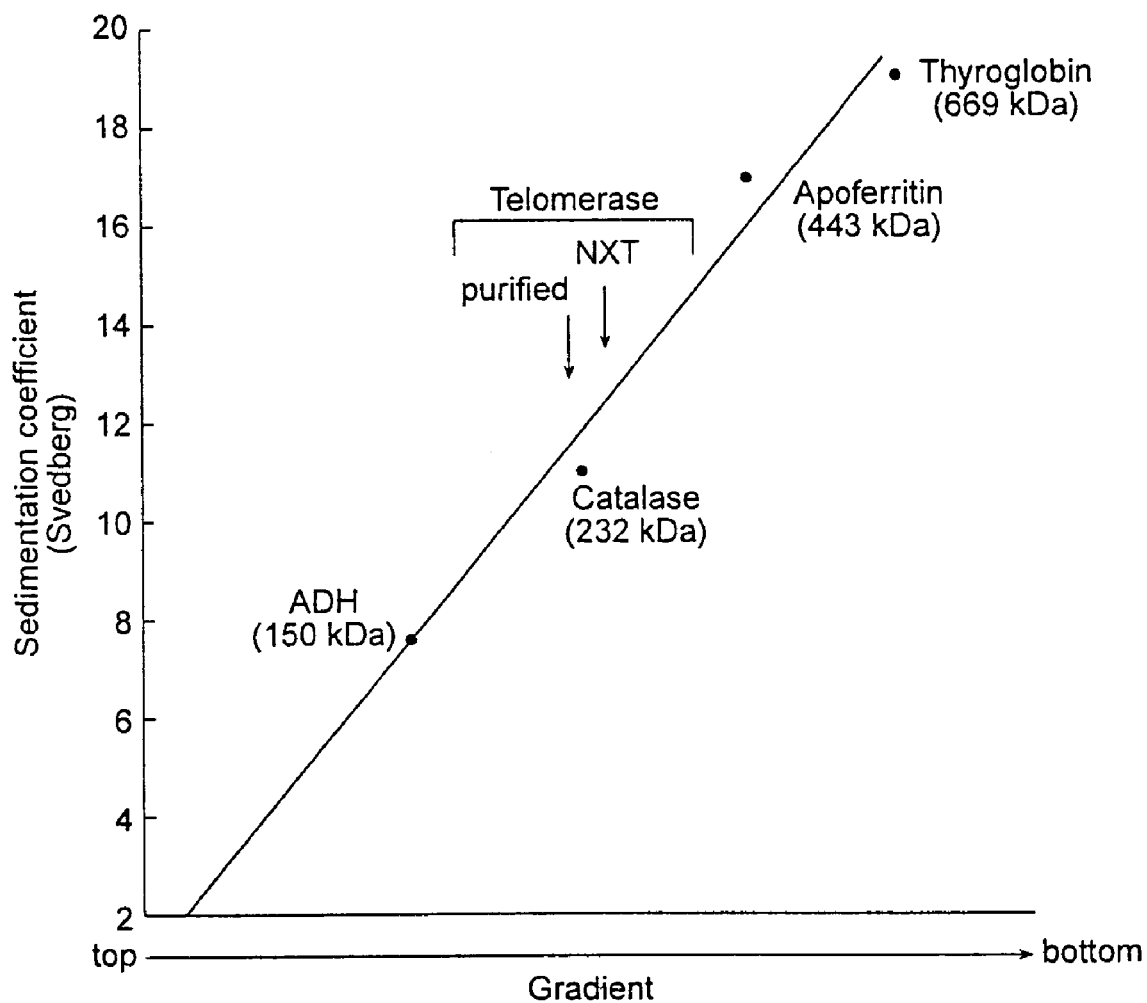
FIG. 30 is a graph showing the sedimentation coefficient of *Euplotes aediculatus* telomerase.

FIG. 30 is a graph showing the sedimentation coefficient for telomerase. As shown in this Figure, affinity-purified telomerase co-sedimented with catalase at 11.5 S, while telomerase in nuclear extracts sedimented slightly faster, peaking around 12.5 S. Therefore, consistent with the mobility of the enzyme in native gels, purified telomerase appears to have lost a proteolytic fragment or a loosely associated subunit.

The calculated molecular mass for telomerase, if it is assumed to consist of one 120 kDa protein subunit, one 43 kDa subunit, and one RNA subunit of 66 kDa, adds up to a total of 229 kDa. This is in close agreement with the 232 kDa molecular mass of catalase. However, the sedimentation coefficient is a function of the molecular mass, as well as the partial specific volume and the frictional coefficient of the molecule, both of which are unknown for the *Euplotes* telomerase RNP.

J. Substrate Utilization

In this Example, the substrate requirements of *Euplotes* telomerase were investigated. One simple model for DNA end replication predicts that after semi-conservative DNA replication, telomerase extends double-stranded, blunt-ended DNA molecules. In a variation of this model, a single-stranded 3' end is created by a helicase or nuclease after replication. This 3' end is then used by telomerase for binding and extension.

To determine whether telomerase is capable of elongating blunt-ended molecules, model hairpins were synthesized with telomeric repeats positioned at their 3' ends. These primer substrates were gel-purified, 5'-end labelled with polynucleotide kinase, heated at 0.4 µM to 80° C. for 5 minutes, and then slowly cooled to room temperature in a heating block, to allow renaturation and helix formation of the hairpins. Substrate mobility on a non-denaturing gel indicated that very efficient hairpin formation was present, as compared to dimerization.

Assays were performed with unlabelled 125 µM dGTP, 125 µM dTTP, and 0.02 µM 5'-end-labelled primer (5'-$^{32}$P-labelled oligonucleotide substrate) in 10 µl reaction mixtures that contained 20 mM Tris-acetate, with 10 mM MgCl$_2$, 50 mM KGlu, and 1 mM DTT, at pH 7.5. These mixtures were incubated at 25° C. for 30 minutes. Reactions were stopped by adding formamide loading buffer (i.e., TBE, formamide, bromthymol blue, and cyanol, Sambrook, 1989, supra).

Primers were incubated without telomerase ("−"), with 5.9 fmol of affinity-purified telomerase ("+"), or with 17.6 fmol of affinity-purified telomerase ("+++"). Affinity-purified telomerase erase used in this assay was dialyzed with a membrane having a molecular cut-off of 100 kDa, in order to remove the displacement oligonucleotide. Reaction products were separated on an 8% PAGE/urea gel containing 36% formamide, to denature the hairpins. The sequences of the primers used in this study, as well as their lane assignments are shown in Table 6.

TABLE 6

Primer Sequences

| Lane | Primer Sequence (5' to 3') | SEQ ID NO: |
|---|---|---|
| 1-3 | $C_4(A_4C_4)_3CACA(G_4T_4)_3G_4$ | 560 |
| 4-6 | $C_2(A_4C_4)_3CACA(G_4T_4)_3G_4$ | 561 |
| 7-9 | $(A_4C_4)_3CACA(G_4T_4)_3G_4$ | 562 |
| 10-12 | $A_2C_4(A_4C_4)_2CACA(G_4T_4)_3G_4$ | 563 |
| 13-15 | $C_4(A_4C_4)_2CACA(G_4T_4)_3$ | 564 |
| 16-18 | $(A_4C_4)_3CACA(G_4T_4)_3$ | 565 |
| 19-21 | $A_2C_4(A_4C_4)_2CACA(G_4T_4)_3$ | 566 |
| 22-24 | $C_4(A_4C_4)_2CACA(G_4T_4)_3$ | 564 |
| 25-27 | $C_2(A_4C_4)_2CACA(G_4T_4)_3$ | 567 |
| 28-30 | $(A_4C_4)_2CACA(G_4T_4)_3$ | 568 |

Figure 31:
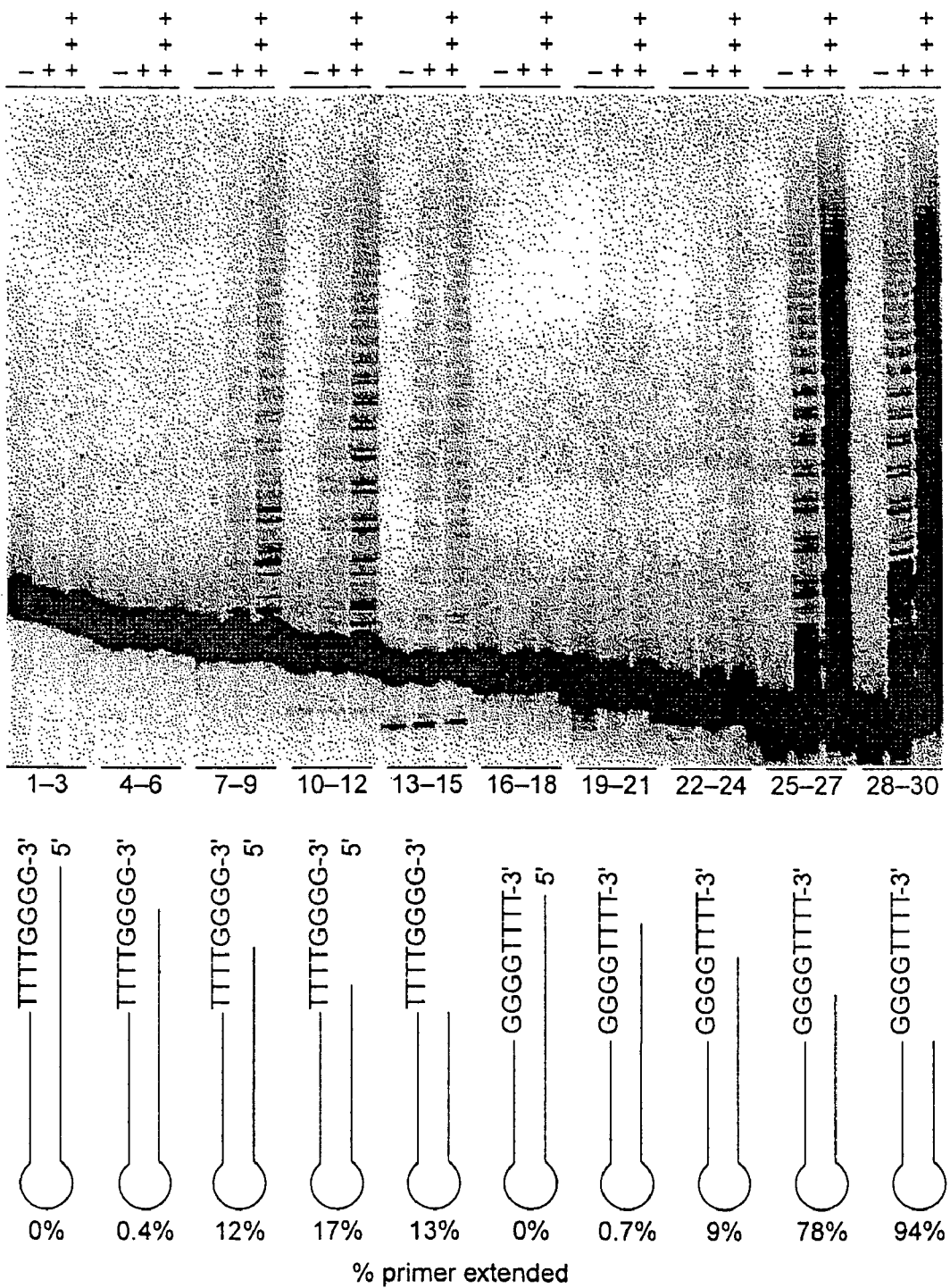
FIG. 31 is a photograph of a polyacrylamide/urea gel with 36% formamide showing the substrate utilization of *Euplotes* telomerase.

The gel results are shown in FIG. 31. Lanes 1-15 contained substrates with telomeric repeats ending with four G residues. Lanes 16-30 contained substrates with telomeric repeats ending with four T residues. The putative alignment on the telomerase RNA template is indicated in FIG. 32. It was assumed that the primer sets anneal at two very different positions in the template shown in FIG. 32 (i.e., Panel A and Panel B, respectively). This may have affected their binding and/or elongation rate.

Figure 33:
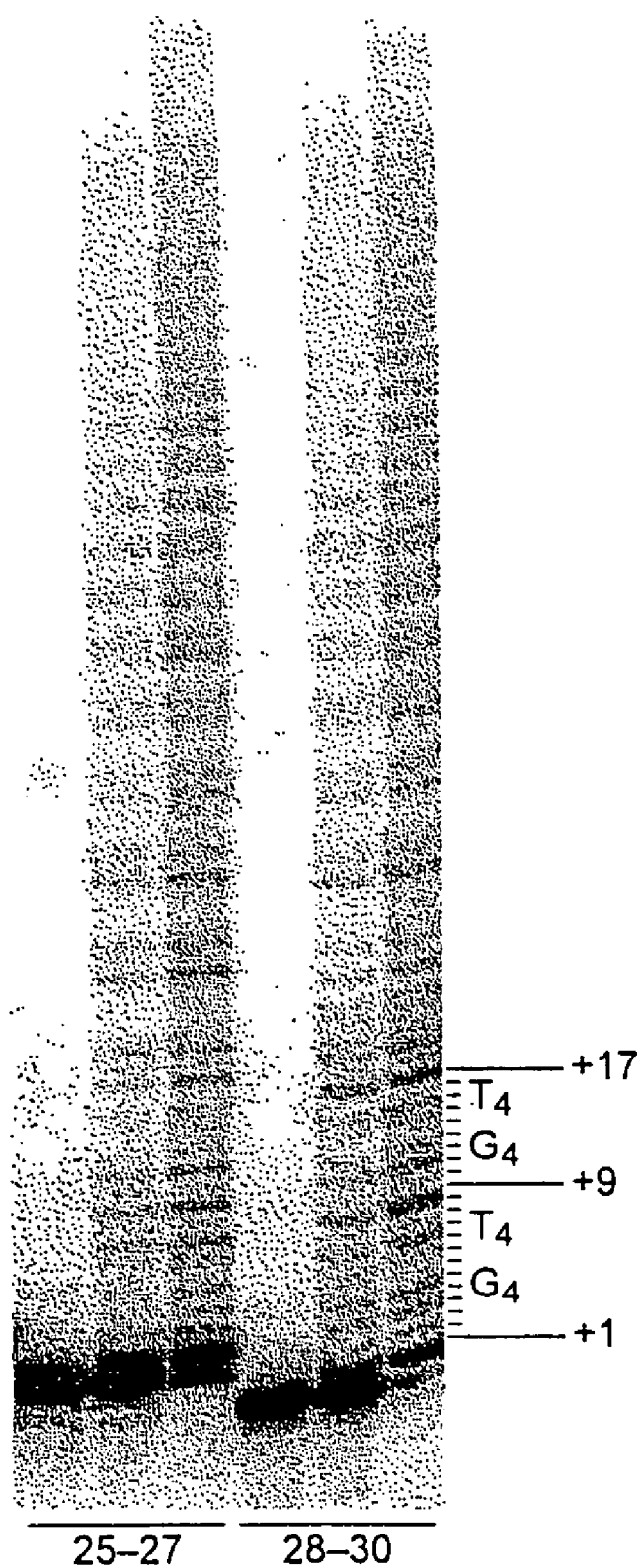
FIG. 33 is a photograph of lanes 25-30 of the gel shown in FIG. 31, shown at a lighter exposure level ($G_4T_4G_4T_4$=SEQ ID NO:114).

FIG. 33 shows a lighter exposure of lanes 25-30 in FIG. 31. The lighter exposure of FIG. 33 was taken to permit visualization of the nucleotides that are added and the positions of pausing in elongated products. Percent of substrate elongated for the third lane in each set was quantified on a PhosphorImager, as indicated on the bottom of FIG. 31.

The substrate efficiencies for these hairpins were compared with double-stranded telomere-like substrates with overhangs of differing lengths. A model substrate that ended with four G residues (see lanes 1-15 of FIG. 31) was not elongated when it was blunt ended (see lanes 1-3). However, slight extension was observed with an overhang length of two bases; elongation became efficient when the overhang was at least 4 bases in length. The telomerase acted in a similar manner with a double-stranded substrate that ended with four T residues, with a 6-base overhang required for highly efficient elongation. In FIG. 31, the faint bands below the primers in lanes 10-15 that are independent of telomerase represent shorter oligonucleotides in the primer preparations.

The lighter exposure of lanes 25-30 in FIG. 33 shows a ladder of elongated products, with the darkest bands correlating with the putative 5' boundary of the template (as described by Lingner et al., Genes Develop., 8:1984 [1994]). The abundance of products that correspond to other positions in the template suggested that pausing and/or dissociation occurs at sites other than the site of translocation with the purified telomerase.

As shown in FIG. 31, double-stranded, blunt-ended oligonucleotides were not substrates for telomerase. To determine whether these molecules would bind to telomerase, a competition experiment was performed. In this experiment, 2 nM of 5'-end labeled substrate with the sequence $(G_4T_4)_2$ (SEQ ID NO:114), or a hairpin substrate with a six base overhang were extended with 0.125 nM telomerase (FIG. 31, lanes 25-27). Although the same unlabeled oligonucleotide substrates competed efficiently with labeled substrate for extension, no reduction of activity was observed when the double-stranded blunt-ended hairpin oligonucleotides were used as competitors, even in the presence of 100-fold excess hairpins.

These results indicated that double-stranded, blunt-ended oligonucleotides cannot bind to telomerase at the concentrations and conditions tested in this Example. Rather, a single-stranded 3' end is required for binding. It is likely that this 3' end is required to base pair with the telomerase RNA template.

K. Cloning & Sequencing of the 123 kDa Polypeptide

In this Example, the cloning of the 123 kDa polypeptide of *Euplotes* telomerase (i.e., the 123 kDa protein subunit) is described. In this study, an internal fragment of the telomerase gene was amplified by PCR, with oligonucleotide primers designed to match peptide sequences that were obtained from the purified polypeptide obtained in Part D, above. The polypeptide sequence was determined using the nanoES tandem mass spectroscopy methods known in the art and described by Calvio et al., RNA 1:724-733 [1995]. The oligonucleotide primers used in this Example had the following sequences, with positions that were degenerate shown in parentheses—5'-TCT(G/A) AA(G/A)TA(G/A)TG (T/G/A)GT(G/A/T/C)A(T/G/A)(G/A)TT(G/A)TTCAT-3 (SEQ ID NO:569), and 5'-GCGGATCCATGAA(T/C)CC(A/T)GA(G/A)AA(T/C)CC(A/T)AA(T/C)GT-3' (SEQ ID NO:570).

A 50 µl reaction contained 0.2 mM dNTPs, 0.15 µg *E. aediculatus* chromosomal DNA, 0.5 µl Taq (Boehringer-Mannheim), 0.8 µg of each primer, and 1× reaction buffer (Boehringer-Mannheim). The reaction was incubated in a thermocycler (Perkin-Elmer), using the following—5 minutes at 95° C., followed by 30 cycles of 1 minute at 94° C., 1 minute at 52° C., and 2 minutes at 72° C. The reaction was completed by a 10 minute incubation at 72EC.

A genomic DNA library was prepared from the chromosomal *E. aediculatus* DNA by cloning blunt-ended DNA into the SmaI site of pCR-Script plasmid vector FIG. 14(Stratagene). This library was screened by colony hybridization, with the radiolabelled, gel-purified PCR product.

Plasmid DNA of positive clones was prepared and sequenced by the dideoxy method (Sanger et al., Proc. Natl. Acad. Sci., 74:5463 [1977]) or manually, through use of an automated sequencer (ABI). The DNA sequence of the gene encoding this polypeptide is shown in FIG. 13. The start codon in this sequence inferred from the DNA sequence, is located at nucleotide position 101, and the open reading frame ends at position 3193. The genetic code of *Euplotes* differs from other organisms in that the "UGA" codon encodes a cysteine residue. The amino acid sequence of the polypeptide inferred from the DNA sequence is shown in FIG. 14, and assumes that no unusual amino acids are inserted during translation and no post-translational modification occurs.

L. Cloning & Sequencing of the 43 kDa Polypeptide

In this Example, the cloning of the 43 kDa polypeptide of telomerase (i.e., the 43 kDa protein subunit) is described. In this study, an internal fragment of the corresponding telomerase gene was amplified by PCR, with oligonucleotide primers designed to match peptide sequences that were obtained from the purified polypeptide obtained in Part D, above. The polypeptide sequence was determined using the nanoES tandem mass spectroscopy methods known in the art and described by Calvio et al., supra. The oligonucleotide primers used in this Example had the following sequences—5'-NNNGTNAC(C/T/A)GG(C/T/A)AT(C/T/A)AA(C/T) AA-3' (SEQ ID NO:571), and 5'-(T/G/A)GC (T/G/A)GT(C/T)TC(T/C)TG(G/A)TC(G/A)TT(G/A)TA-3' (SEQ ID NO:572). In this sequence, "N" indicates the presence of any of the four nucleotides (i.e., A, T, G, or C).

The PCR was performed as described in Part K.

A genomic DNA library was prepared and screened as described in Part K. The DNA sequence of the gene encoding this polypeptide is shown in FIG. 34. Three potential reading frames are shown for this sequence, as shown in FIG. 35. For clarity, the amino acid sequence is indicated below the nucleotide sequence in all three reading frames. These reading frames are designated as "a," "b," and "c". A possible start codon is encoded at nucleotide position 84 in reading frame "c." The coding region could end at position 1501 in reading frame "b." Early stop codons, indicated by asterisks in this figure, occur in all three reading frames between nucleotide position 337-350.

Further downstream, the protein sequence appears to be encoded by different reading frames, as none of the three frames is uninterrupted by stop codons. Furthermore, peptide sequences from purified protein are encoded in all three frames. Therefore, this gene appears to contain intervening sequences, or in the alternative, the RNA is edited. Other possibilities include ribosomal frame-shifting or sequence errors. However, the homology to the La-protein sequence remains of significant interest. Again, in *Euplotes*, the "UGA" codon encodes a cysteine residue.

M. Amino Acid and Nucleic Acid Comparisons

In this Example, comparisons between various reported sequences and the sequences of the 123 kDa and 43 kDa telomerase subunit polypeptides were made.

i) Comparisons with the 123 kDa *E. aediculatus* Telomerase Subunit

The amino acid sequence of the 123 kDa *Euplotes aediculatus* polypeptide was compared with the sequence of the 80 kDa telomerase protein subunit of *Tetrahymena thermophila* (GenBank accession #U25641) to investigate their similarity. The nucleotide sequence as obtained from GenBank encoding this protein is shown in FIG. 42. The amino acid sequence of this protein as obtained from GenBank is shown in FIG. 43. The sequence comparison between the 123 kDa *E. aediculatus* and 80 kDa *T. thermophila* is shown in FIG. 36. In this figure, the *E. aediculatus* sequence is the upper sequence, while the *T. thermophila* sequence is the lower sequence. The observed identity was determined to be approximately 19%, while the percent similarity was approximately 45%, values similar to what would be observed with any random protein sequence. In FIGS. 36-39, identities are indicated by vertical bars, while single dots between the sequences indicate somewhat similar amino acids, and double dots between the sequences indicate more similar amino acids.

The amino acid sequence of the 123 kDa *Euplotes aediculatus* polypeptide was also compared with the sequence of the 95 kDa telomerase protein subunit of *Tetrahymena thermophila* (GenBank accession #U25642), to investigate their similarity. The nucleotide sequence as obtained from GenBank encoding this protein is shown in FIG. 44. The amino acid sequence of this protein as obtained from GenBank is shown in FIG. 45. This sequence comparison is shown in FIG. 37. In this figure, the *E. aediculatus* sequence is the upper sequence), while the *T. thermophila* sequence is the lower sequence. The observed identity was determined to be approximately 20%, while the percent similarity was approximately 43%, values similar to what would be observed with any random protein sequence.

Significantly, the amino acid sequence of the 123 kDa *E. aediculatus* polypeptide contains the five motifs characteristic of reverse transcriptases. The 123 kDa polypeptide was also compared with the polymerase domains of various reverse transcriptases. FIG. 40 shows the alignment of the 123 kDa polypeptide with the putative yeast homolog (L8543.12 or ESTp). The amino acid sequence of L8543.12 obtained from GenBank is shown in FIG. 46.

Four motifs (A, B, C, and D) were included in this comparison. In this FIG. 40, highly conserved residues are indicated by white letters on a black background. Residues of the *E. aediculatus* sequences that are conserved in the other sequence are indicated in bold; the "h" indicates the presence of a hydrophobic amino acid. The numerals located between amino acid residues of the motifs indicates the length of gaps in the sequences. For example, the "100" shown between motifs A and B reflects a 100 amino acid gap in the sequence between the motifs.

As noted above, Genbank searches identified a yeast protein (Genbank accession #u20618), and gene L8543.12 (Est2) containing or encoding amino acid sequence that shows some homology to the *E. aediculatus* 123 kDa telomerase subunit. Based on the observations that both proteins contain reverse transcriptase motifs in their C-terminal regions; both proteins share similarity in regions outside the reverse transcriptase motif; the proteins are similarly basic (pI=10.1 for *E. aediculatus* and pI=10.0 for the yeast); and both proteins are large (123 kDa for *E. aediculatus* and 103 kDa for the yeast), these sequences comprise the catalytic core of their respective telomerases. It was contemplated based on this observation of homology in two phylogenetically distinct organisms as *E. aediculatus* and yeast, that human telomerase would contain a protein that has the same characteristics (i.e., reverse transcriptase motifs, is basic, and large [>100 kDa]).

ii) Comparisons with the 43 kDa *E. aediculatus* Telomerase Subunit

The amino acid sequence of the "La-domain" of the 43 kDa *Euplotes aediculatus* polypeptide was compared with the sequence of the 95 kDa telomerase protein subunit of *Tetrahymena thermophila* (described above) to investigate their similarity. This sequence comparison is shown in FIG. 38, while the *T. thermophila* sequence is the lower sequence. The observed identity was determined to be approximately 23%, while the percent similarity was approximately 46%, values similar to what would be observed with any random protein sequence.

The amino acid sequence of the "La-domain" of the 43 kDa *Euplotes aediculatus* polypeptide was compared with the sequence of the 80 kDa telomerase protein subunit of *Tetrahymena thermophila* (described above) to investigate their similarity. This sequence comparison is shown in FIG. 39. In this figure, the *E. aediculatus* sequence is the upper sequence, while the *T. thermophila* sequence is the lower sequence. The observed identity was determined to be approximately 26%, while the percent similarity was approximately 49%, values similar to what would be observed with any random protein sequence.

The amino acid sequence of a domain of the 43 kDa *E. aediculatus* polypeptide was also compared with La proteins from various other organisms. These comparisons are shown in FIG. 41. In this Figure, highly conserved residues are indicated by white letters on a black background. Residues of the *E. aediculatus* sequences that are conserved in the other sequence are indicated in bold.

N. Identification of Telomerase Protein Subunits in Another Organism

In this Example, the sequences identified in the previous Examples above were used to identify the telomerase protein subunits of *Oxytricha trifallax*, a ciliate that is very distantly related to *E. aediculatus*. Primers were chosen based on the conserved region of the *E. aediculatus* 123 kDa polypeptide which comprised the reverse transcriptase domain motifs. Suitable primers were synthesized and used in a PCR reaction with total DNA from *Oxytricha*. The *Oxytricha* DNA was prepared according to methods known in the art. The PCR products were then cloned and sequenced using methods known in the art.

The oligonucleotide sequences used as the primers were as follows: 5'-(T/C)A(A/G)AC(T/A/C)AA(G/A)GG(T/A/C)AT(T/C)CC(C/T/A)(C/T)A(G/A) GG-3' (SEQ ID NO:573) and 5'-(G/A/T)GT(G/A/T)ATNA(G/A)NA(G/A)(G/A)TA(G/A)TC(G/A)TC-3' (SEQ ID NO:574). Positions that were degenerate are shown in parentheses, with the alternative bases shown within the parenthesis. "N" represents any of the four nucleotides.

In the PCR reaction, a 50 µl reaction contained 0.2 mM dNTPs, 0.3 µg *Oxytricha trifallax* chromosomal DNA, 1 µl Taq polymerase (Boehringer-Mannheim), 2 micromolar of each primer, 1× reaction buffer (Boehringer-Mannheim). The reaction was incubated in a thermocycler (Perkin-Elmer) under the following conditions: 5 min at 95° C., 30 cycles consisting of 1 min at 94° C., 1 min at 53° C., and 1 min at 72° C., followed by a 10 min incubation at 72° C. The PCR-product was gel-purified and sequenced by the dideoxy-method (e.g., Sanger et al., Proc. Natl. Acad. Sci. 74, 5463-5467 (1977).

The deduced amino acid sequence of the PCR product was determined and compared with the *E. aediculatus* sequence. FIG. 47 shows the alignment of these sequences, with the *O. trifallax* sequence shown in the top row, and the *E. aediculatus* sequence shown in the bottom row. As can be seen from this figure, there is a great deal of homology between the *O. trifallax* polypeptide sequence identified in this Example with the *E. aediculatus* polypeptide sequence. Thus, it is clear that the sequences identified in the present invention are useful for the identification of homologous telomerase protein subunits in other eukaryotic organisms. Indeed, development of the present invention has identified homologous telomerase sequences in multiple, diverse species, as described herein.

O. Identification of *Tetrahymena* Telomerase Sequences

In this Example, a *Tetrahymena* clone was produced that shares homology with the *Euplotes* sequences, and EST2p.

This experiment utilized PCR with degenerate oligonucleotide primers directed against conserved motifs to identify regions of homology between *Tetrahymena*, *Euplotes*, and EST2p sequences. The PCR method used in this Example is a novel method designed to amplify specifically rare DNA sequences from complex mixtures. This method avoids the problem of amplification of DNA products with the same PCR primer at both ends (i.e., single primer products) commonly encountered in PCR cloning methods. These single primer products produce unwanted background and can often obscure the amplification and detection of the desired two-primer product. The method used in this experiment preferentially selects for two-primer products. In particular, one primer is biotinylated and the other is not. After several rounds of PCR amplification, the products are purified using streptavidin magnetic beads and two primer products are specifically eluted using heat denaturation. This method finds use in settings other than the experiments described in this Example. Indeed, this method finds use in application in which it is desired to specifically amplify rare DNA sequences, including the preliminary steps in cloning methods such as 5' and 3' RACE, and any method that uses degenerate primers in PCR.

A first PCR run was conducted using *Tetrahymena* template macronuclear DNA isolated using methods known in the art, and the 24-mer forward primer with the sequence 5' biotin-GCCTATTT(TC)TT(TC)TA(TC)(GATC)(GATC)(GATC)AC(GATC)GA-3' (SEQ ID NO:575) designated as "K231," corresponding to the FFYXTE SEQ ID NO:360 region, and the 23-mer reverse primer with the sequence 5'-CCAGATAT(GATC)A (TGA)(GATC)A(AG)(AG)AA(AG)TC(AG)TC-3' (SEQ ID NO:576), designated as "K220," corresponding to the DDFL(FIL)I(SEQ ID NO:577) region. This PCR reaction contained 2.5 µl DNA (50 ng), 4 µl of each primer (20 µM), 3 µl 10×PCR buffer, 3 µl 10× dNTPs, 2 µl Mg, 0.3 µl Taq, and 11.2 µl dH$_2$O. The mixture was cycled for 8 cycles of 94° C. for 45 seconds, 37° C. for 45 seconds, and 72° C. for 1 minute.

This PCR reaction was bound to 200 µl streptavidin magnetic beads, washed with 200 µl TE, resuspended in 20 µl dH$_2$O and then heat-denatured by boiling at 100° C. for 2 minutes. The beads were pulled down and the eluate removed. Then, 2.5 µl of this eluate was subsequently reamplified using the above conditions, with the exception being that 0.3 µl of α-$^{32}$P dATP was included, and the PCR was carried out for 33 cycles. This reaction was run a 5% denaturing polyacrylamide gel, and the appropriate region was cut out of the gel. These products were then reamplified for an additional 34 cycles, under the conditions listed above, with the exception being that a 42° C. annealing temperature was used.

A second PCR run was conducted using *Tetrahymena* macronuclear DNA template isolated using methods known in the art, and the 23-mer forward primer with the sequence 5'-ACAATG(CA)G(GATC)(TCA)T(GATC)(TCA)T (GATC)CC (GATC)AA(AG)AA-3' (SEQ ID NO:578), designated as "K228," corresponding to the region R(LI)(LI) PKK (SEQ ID NO:579), and a reverse primer with the sequence 5'-ACGAATC(GT)(GATC)G (TAG)AT(GATC)(GC)(TA)(AG)TC(AG)TA(AG)CA 3' (SEQ ID NO:580), designated "K224," corresponding to the CYDSIPR (SEQ ID NO:581) region. This PCR reaction contained 2.5 µl DNA (50 ng), 4 µl of each primer (20 µM), 3 µl 10×PCR buffer, 3 µl 10× dNTPs, 2 µl Mg, 0.3 µl α-$^{32}$P dATP, 0.3 µl Taq, and 10.9 µl dH$_2$O. This reaction was run on a 5% denaturing polyacrylamide gel, and the appropriate region was cut out of the gel. These products were reamplified for an additional 34 cycles, under the conditions listed above, with the exception being that a 42° C. annealing temperature was used.

Ten µl of the reaction product from run 1 were bound to streptavidin-coated magnetic beads in 200 µl TE. The beads were washed with 200 μl TE, and then resuspended in 20 μl of dH₂O, heat denatured, and the eluate was removed. The reaction product from run 2 was then added to the beads and diluted with 30 μl 0.5×SSC. The mixture was heated from 94° C. to 50° C. The eluate was removed and the beads were washed three times in 0.5×SSC at 55EC. The beads were then resuspended in 20 μl dH₂O, heat denatured, and the eluate was removed, designated as "round 1 eluate" and saved.

To isolate the *Tetrahymena* band, the round 1 eluate was reamplified with the forward primer K228 and reverse primer K227 with the sequence 5'-CAATTCTC(AG)TA (AG)CA(GATC)(CG)(TA)(CT)TT(AGT)AT(GA)TC-3' (SEQ ID NO:582), corresponding to the DIKSCYD (SEQ ID NO:583) region. The PCR reactions were conducted as described above. The reaction products were run on a 5% polyacrylamide gel; the band corresponding to approximately 295 nucleotides was cut from the gel and sequenced.

The clone designated as 168-3 was sequenced. The DNA sequence (including the primer sequences) was found to be:

This amino acid sequence was then aligned with other telomerase genes (EST2p, and *Euplotes*). The alignment is shown in FIG. 53. A consensus sequence is also shown in this Figure.

P. Identification of *Schizosaccharomyces pombe* Telomerase Sequences

In this Example, the tez1 sequence of *S. pombe* was identified as a homolog of the *E. aediculatus* p123, and *S. cerevisiae* Est2p.

Figure 55A:
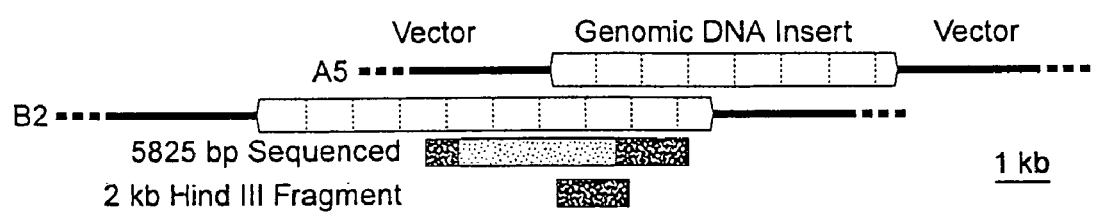
FIGS. 55A and 55B present a schematic summary of the tez1⁺ sequencing experiments.
Figure 55B:
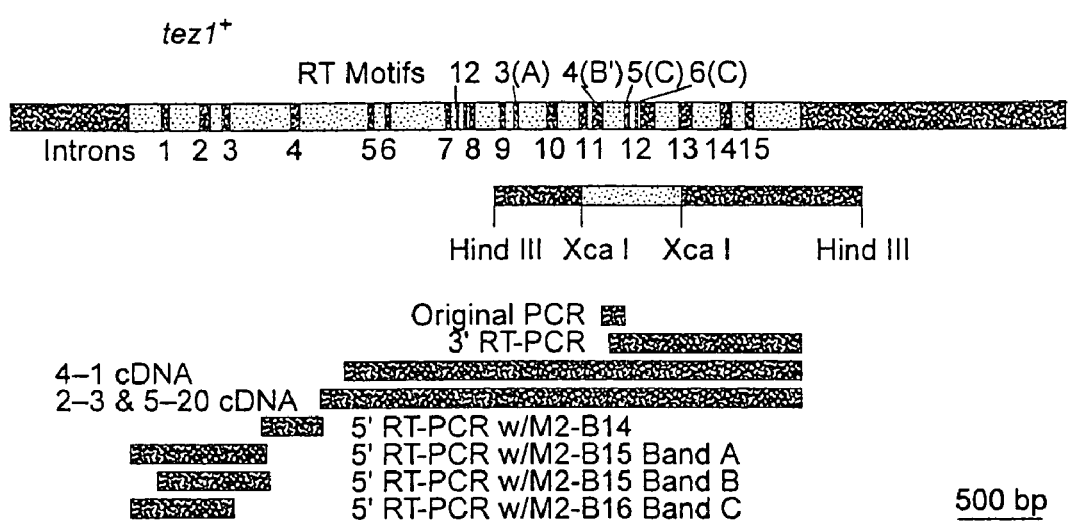

FIG. 55 provides an overall summary of these experiments. In this Figure, the top portion (Panel A) shows the relationship of two overlapping genomic clones, and the 5825 bp portion that was sequenced. The region designated at "tez1⁺" is the protein coding region, with the flanking sequences indicated as well, the box underneath the 5825 bp region is an approximately 2 kb HindIII fragment that was used to make the tez1 disruption construct, as described below.

```
GATTACTCCCGAAGAAAGGATCTTTCCGTCCAATCATGACTTTCTTAAGAAAGGA

CAAGCAAAAAATATTAAGTTAAATCTAAATTAAATTCTAATGGATAGCCAACTT

GTGTTTAGGAATTTAAAAGACATGCTGGGATAAAAGATAGGATACTCAGTCTTTG

ATAATAAACAAATTTCAGAAAAATTTGCCTAATTCATAGAGAAATGGAAAAATA

AAGGAAGACCTCAGCTATATTATGTCACTCTAGACATAAAGACTTGCTAC (SEQ

ID NO:584).
```

Additional sequence of this gene was obtained by PCR using one unique primer designed to match the sequence from 168-3 ("K297" with the sequence 5'-GAGTGACAT-AATATACGTGA-3' (SEQ ID NO:585); and the K231 (FFYXTE; SEQ ID NO:360) primer. The sequence of the fragment obtained from this reaction, together with 168-3 is as follows (without the primer sequences):

The bottom half of FIG. 55 (Panel B) is a "close-up" schematic of this same region of DNA. The sequence designated as "original PCR" is the original degenerate PCR fragment that was generated with a degenerate oligonucleotide primer pair designed based on *Euplotes* sequence motif 4 (B') and motif 5 (C), as described.

i) PCR With Degenerate Primers

```
AAACACAAGGAAGGAAGTCAAATATTCTATTACCGTAAACCAATATGGAAATTA

GTGAGTAAATTAACTATTGTCAAAGTAAGAATTTAGTTTTCTGAAAAGAATAAAT

AAATGAAAAATAATTTTTATCAAAAAATTTAGCTTGAAGAGGAGAATTTGGAAA

AAGTTGAAGAAAAATTGATACCAGAAGATTCATTTTAGAAATACCCTCAAGGAA

AGCTAAGGATTATACCTAAAAAAGGATCTTTCCGTCCAATCATGACTTTCTTAAG

AAAGGACAAGCAAAAAAATATTAAGTTAAATCTAAATTAAATTCTAATGGATAG

CCAACTTGTGTTTAGGAATTTAAAAGACATGCTGGGATAAAAGATAGGATACTCA

GTCTTTGATAATAAACAAATTTCAGAAAAATTTGCCTAATTCATAGAGAAATGGA

AAAATAAAGGAAGACCTCAGCTATATTATGTCACTCTA (SEQ ID NO:586).
```

The amino acid sequence corresponding to this DNA fragment was found to be:

PCR using degenerate primers was used to find the homolog of the *E. aediculatus* p123 in *S. pombe*. FIG. 56

```
KHKEGSQIFYYRKPIWKLVSKLTIVKVRIQFSEKNKQMKNNFYQKIQLEEENLEKVEE

KLIPEDSFQKYPQGKLRIIPKKGSFRPIMTFLRKDKQKNIKLNLNQILMDSQLVFRNKL

Figure 57:
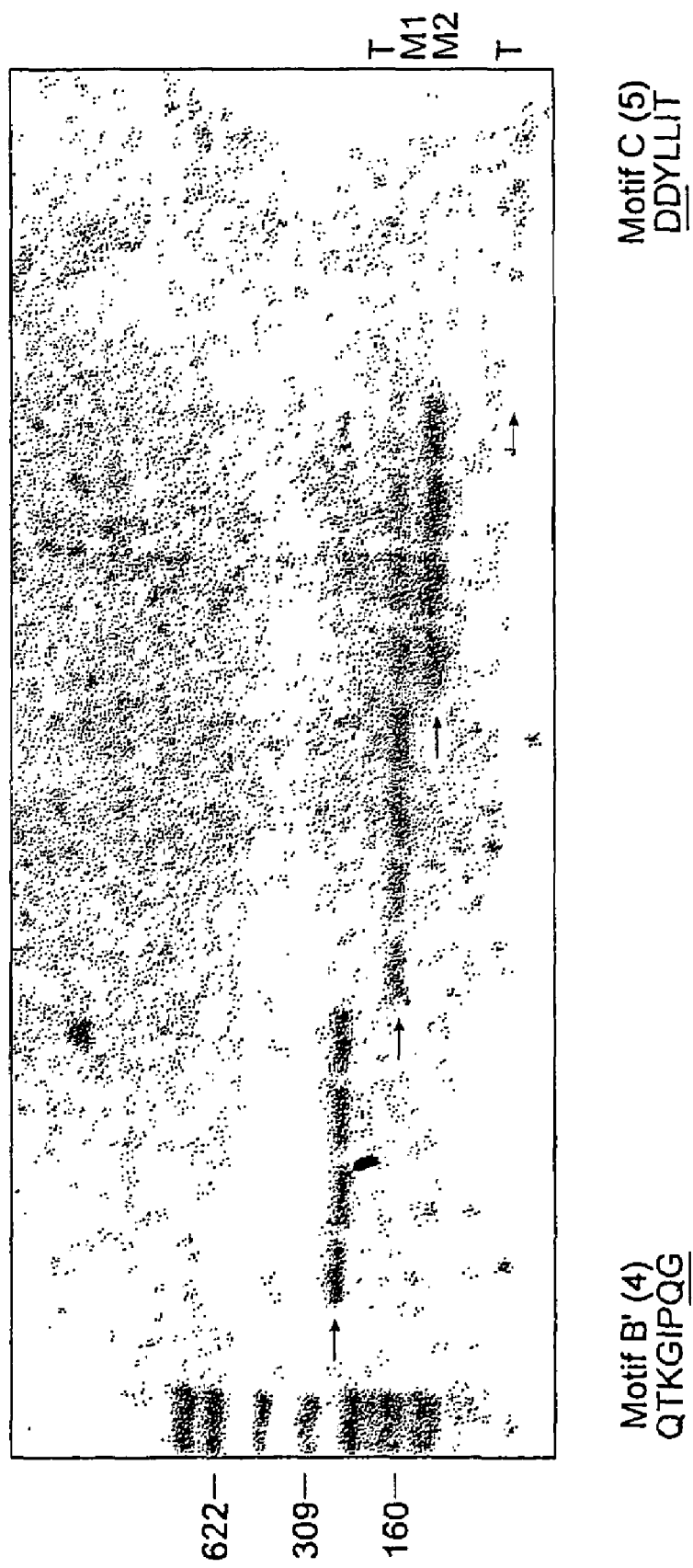
FIG. 57 shows the four major bands produced in PCR using degenerate primers to identify the *S. pombe* homolog of the *E. aediculatus* p123 sequences (SEQ ID NOS:239 and 240).

DMLGQKIGYSVFDNKQISEKFAQFIEKWKNKGRPQLYYVTL (SEQ ID NO:228).
``` shows the sequences of the degenerate primers (designated as "poly 4" and "poly 1") used in this reaction. The PCR runs were conducted using the same buffer as described in previous Examples (See e.g., Part K, above), with a 5 minute ramp time at 94° C., followed by 30 cycles of 94° C. for 30 seconds, 50° C. for 45 seconds, and 72° C. for 30 seconds, and 7 minutes at 72° C., followed by storage at 4° C. PCR runs were conducted using varied conditions, (i.e., various concentrations of S. pombe DNA and $MgCl_2$ concentrations). The PCR products were run on agarose gels and stained with ethidium bromide as described above. Several PCR runs resulted in the production of three bands (designated as "T," "M," and "B"). These bands were re-amplified and run on gels using the same conditions as described above. Four bands were observed following this re-amplification ("T," "M1," "M2," and "B"), as shown in FIG. 57. These four bands were then re-amplified using the same conditions as described above. The third band from the top of the lane in FIG. 57 was identified as containing the correct sequence for a telomerase protein. The PCR product designated as M2 was found to show a reasonable match with other telomerase proteins, as indicated in FIG. 58. In addition to the alignment shown, this Figure also shows the actual sequence of tez1. In this Figure, the asterisks indicate residues shared with all four sequences (*Oxytricha* "Ot"; *E. aediculatus* "Ea_p123"; *S. cerevisiae* "Sc_p103"; and M2), while the circles (i.e., dots) indicate similar amino acid residues.

ii) 3' RT PCR

Figure 59:
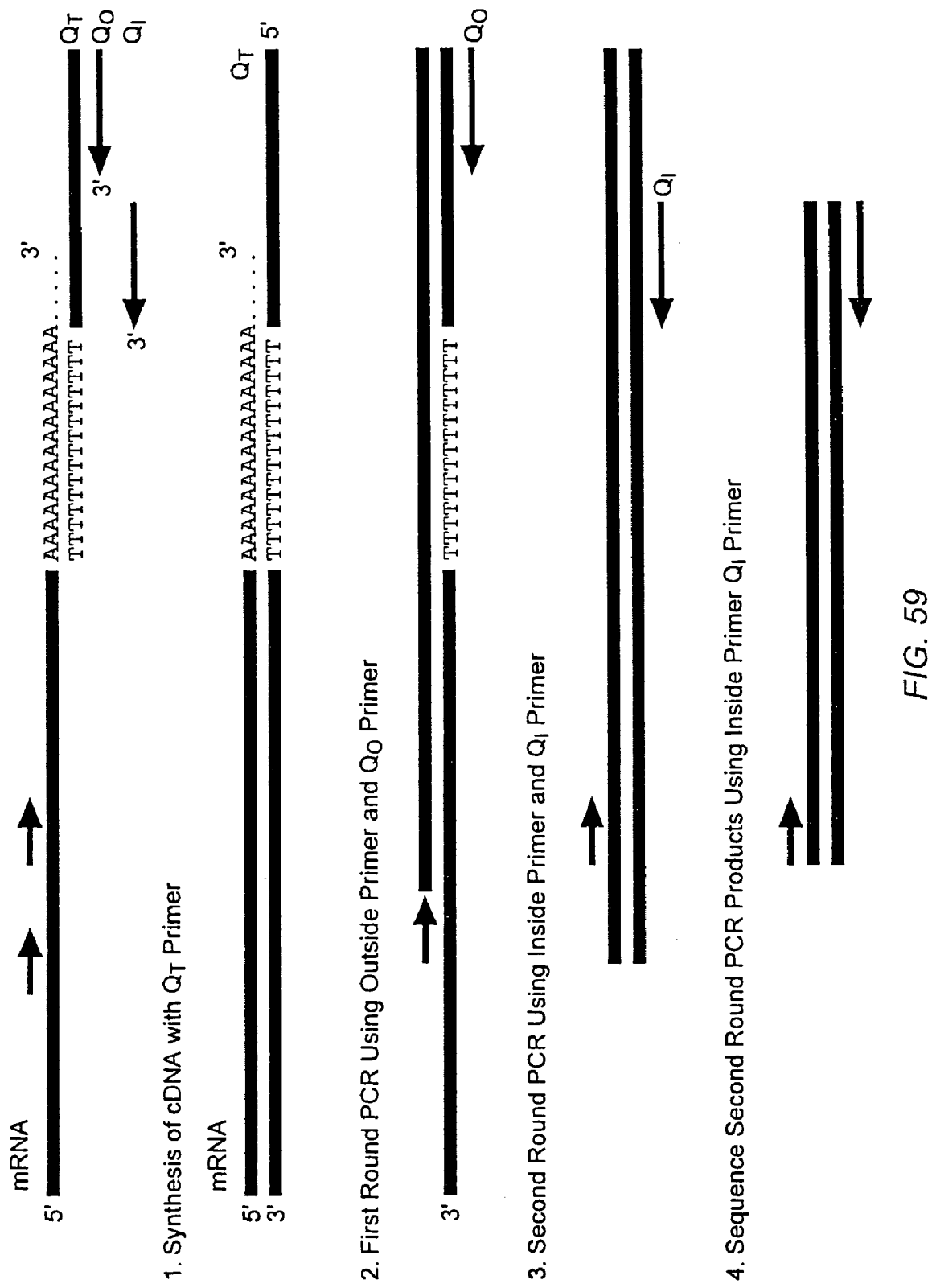
FIG. 59 is a schematic showing the 3' RT PCR strategy for identifying the *S. pombe* homolog of the *E. aediculatus* p123.

To obtain additional sequence information, 3' and 5' RT PCR were conducted on the telomerase candidate identified in FIG. 58. FIG. 59 provides a schematic of the 3' RT PCR strategy used. First, cDNA was prepared from mRNA using the oligonucleotide primer "$Q_T$," (5'-CCA GTG AGC AGA GTG ACG AGG ACT CGA GCT CAA GCT TTT TTT TTT TTT TT-3'; SEQ ID NO:587), then using this cDNA as a template for PCR with "$Q_O$" (5'-CCA GTG AGC AGA GTG ACG-3'; SEQ ID NO:588), and a primer designed based on the original degenerated PCR reaction (i.e., "M2-T" with the sequence 5'-G TGT CAT TTC TAT ATG GAA GAT TTG ATT GAT G-3'; SEQ ID NO:589). The second PCR reaction (i.e., nested PCR) with "$Q_I$," (5'-GAG GAC TCG AGC TCA AGC-3'; SEQ ID NO:590), and another PCR primer designed with sequence derived from the original degenerate PCR reaction or "M2-T2" (5'-AC CTA TCG TTT ACG AAA AAG AAA GGA TCA GTG-3'; SEQ ID NO:591). The buffers used in this PCR were the same as described above, with amplification conducted beginning with a ramp up of 94° for 5 min, followed by 30 cycles of 94° for 30 sec, 55° C. for 30 sec, and 72° C. for 3 min, followed by 7 minutes at 72° C. The reaction products were stored at 4° C. until use.

iii) Screening of Genomic and cDNA Libraries

Figure 61:
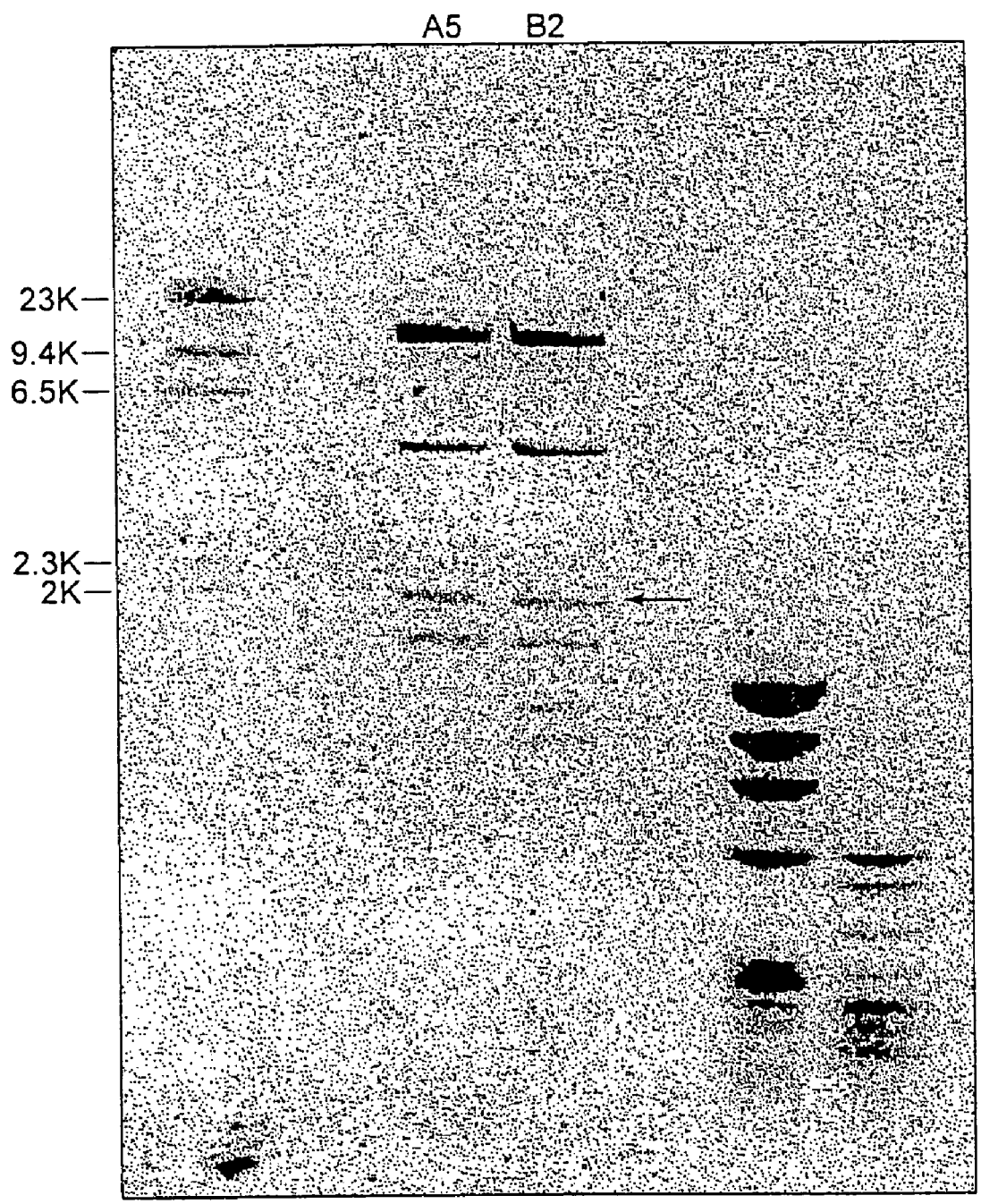
FIG. 61 shows the positive results obtained with the HindIII-digested positive genomic clones containing *S. pombe* telomerase sequence.

After obtaining this additional sequence information, several genomic and cDNA libraries were screened to identify any libraries that contain this telomerase candidate gene. The approach used, as well as the libraries and results are shown in FIG. 60. In this Figure, Panel A lists the libraries tested in this experiment; Panel B shows the regions used; Panels C and D show the dot blot hybridization results obtained with these libraries. Positive libraries were then screened by colony hybridization to obtain genomic and cDNA version of tez1 gene. In this experiment, approximately $3\times10^4$ colonies from the HindIII genomic library were screened and six positive clones were identified (approximately 0.01%). DNA was then prepared from two independent clones (A5 and B2). FIG. 61 shows the results obtained with the HindIII-digested A5 and B2 positive genomic clones.

In addition, cDNA REP libraries were used. Approximately $3\times10^5$ colonies were screened, and 5 positive clones were identified (0.002%). DNA was prepared from three independent clones (2-3, 4-1, and 5-20). In later experiments, it was determined that clones 2-3 and 5-20 contained identical inserts.

iv) 5' RT PCR

Figure 62:
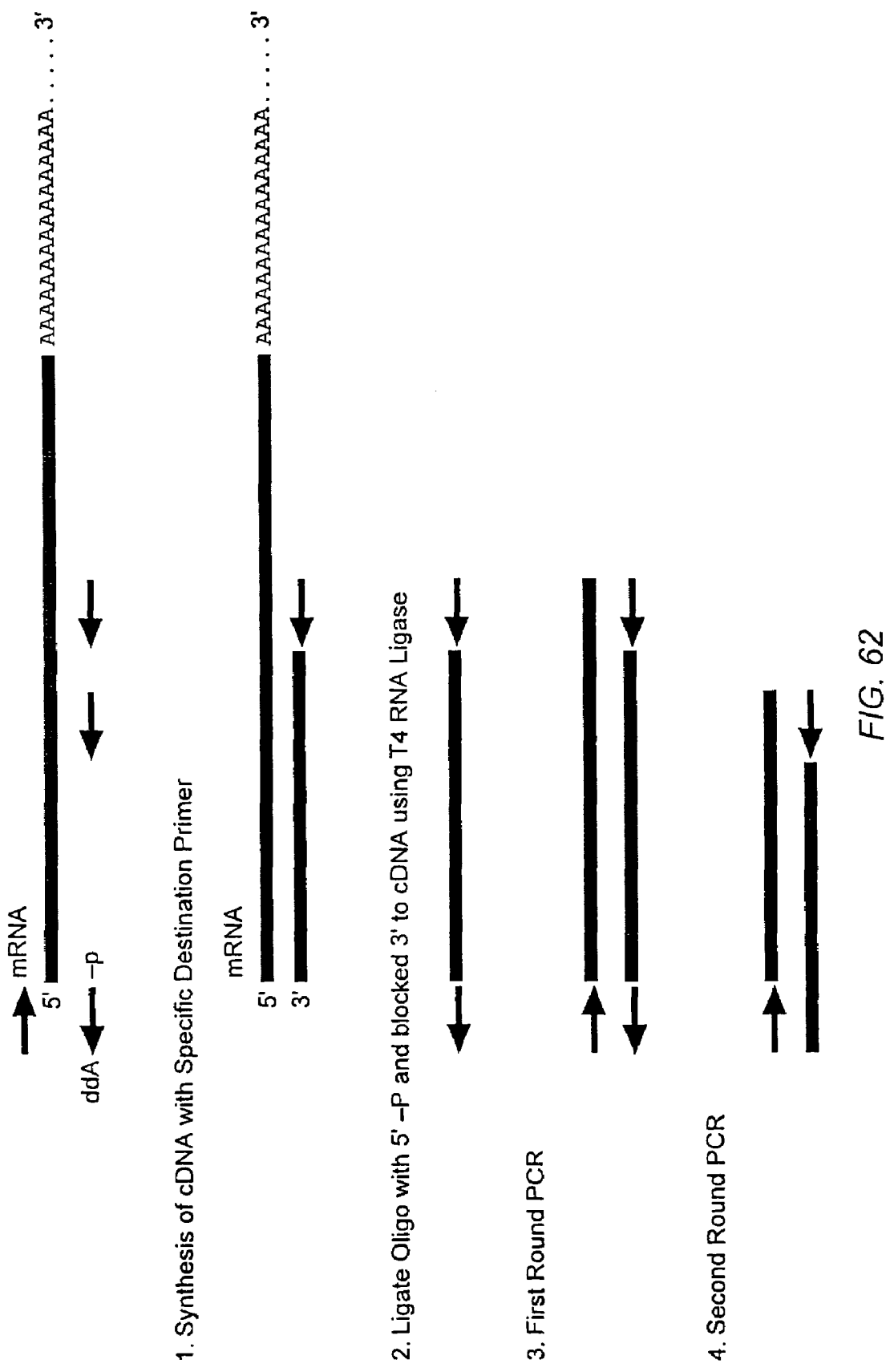
FIG. 62 is a schematic showing the 5' RT PCR strategy used to obtain a full length *S. pombe* TRT clone.

As the cDNA version of gene produced to this point was not complete, 5' RT-PCR was conducted to obtain a full length clone. The strategy is schematically shown in FIG. 62. In this experiment, cDNA was prepared using DNA oligonucleotide primer "M2-B" (5'-CAC TGA TCC TTT CTT TTT CGT AAA CGA TAG GT-3'; SEQ ID NO:592) and "M2-B2" (5'-C ATC AAT CAA ATC TTC CAT ATA GAA ATG ACA-3'; SEQ ID NO:593), designed from known regions of tez1 identified previously. An oligonucleotide linker PCR Adapt SfiI with a phosphorylated 5' end ("P") (P-GGG CCG TGT TGG CCT AGT TCT CTG CTC-3' SEQ ID NO:594; was then ligated at the 3' end of this cDNA, and this construct was used as the template for nested PCR. In the first round of PCR, PCR Adapt SFI and M2-B were used as the primers; while PCR Adapt SfiI (5'-GAG GAG GAG AAG AGC AGA GAA CTA GGC CAA CAC GCC CC-3'; SEQ ID NO:595), and M2-B2 were used as primers in the second round. Nested PCR was used to increase specificity of reaction.

v) Sequence Alignments

Once the sequence of tez1 was identified, it was compared with sequences previously described. FIG. 63 shows the alignment of RT domains from telomerase catalytic subunits of *S. pombe* ("S.p. Tez1p"), *S. cerevisiae* ("S.c. Est2p"), and *E. aediculatus* p123 ("E.a. p123"). In this Figure, "h" indicates hydrophobic residues, while "p" indicates small polar residues, and "c" indicates charged residues. The amino acid residues indicated above the alignment show a known consensus RT motif of Y. Xiong and T. H. Eickbush (Y. Xiong and T. H. Eickbush, EMBO J., 9: 3353-3362 [1990]). The asterisks indicate the residues that are conserved for all three proteins. "Motif O" is identified herein and in FIG. 63 as a motif specific to this telomerase subunit and not found in reverse transcriptases in general. It is therefore valuable in identifying other amino acid sequences as telomerase catalytic subunits.

FIG. 64 shows the alignment of entire sequences from *Euplotes* ("Ea_p123"), *S. cerevisiae* ("Sc_Est2p"), and *S. pombe* ("Sp_Tez1p"). In Panel A, the shaded areas indicate residues shared between two sequences. In Panel B, the shaded areas indicate residues shared between all three sequences.

vi) Genetic Disruption of tez1

In this Example, the effects of disruption of tez1 were investigated. As telomerase is involved in telomere maintenance, it was hypothesized that if tez1 were indeed a telomerase component, disruption of tez1 would cause gradual telomere shortening.

Figure 65:
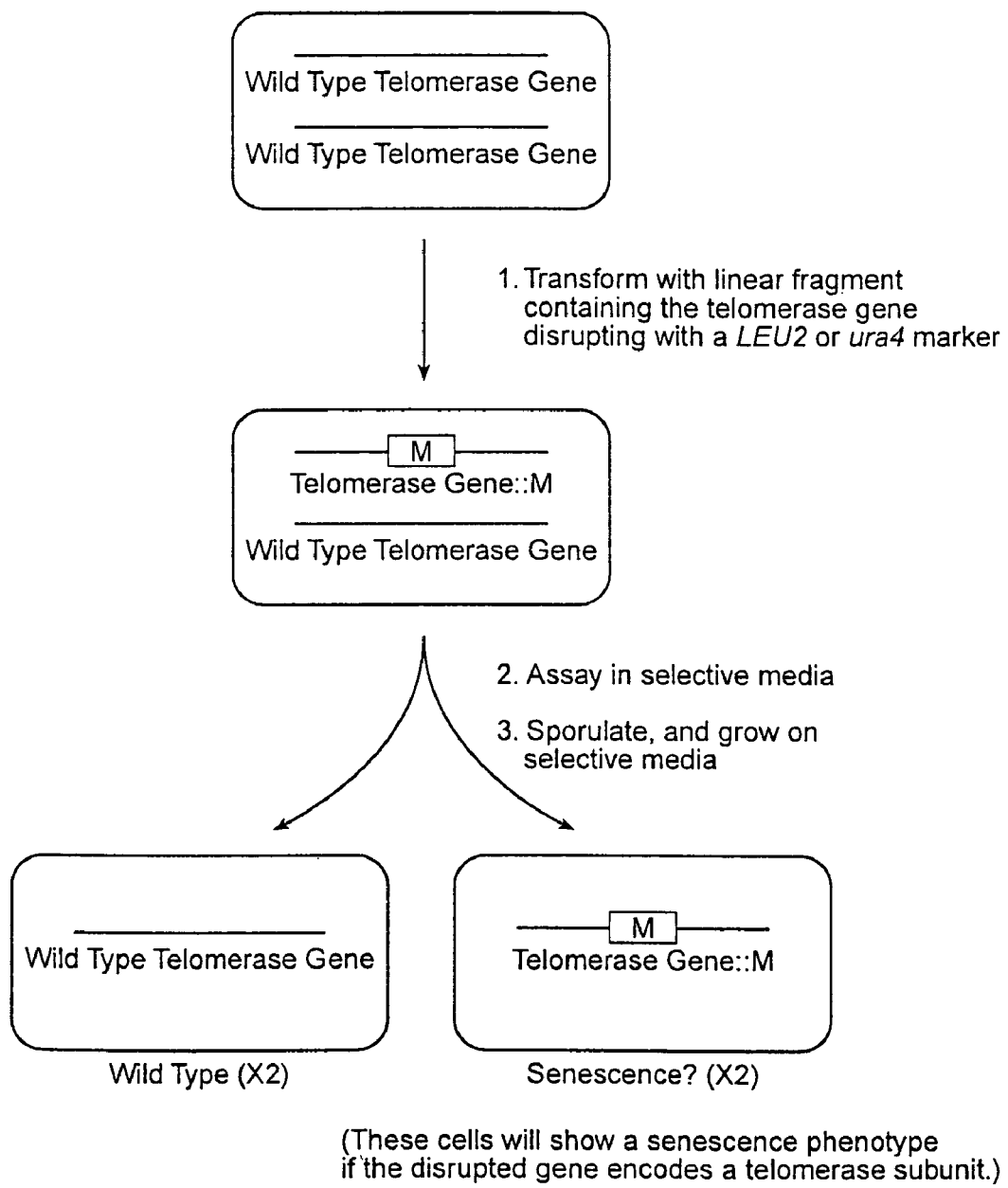
FIG. 65 shows the disruption strategy used with the telomerase genes in *S. pombe*.

In these experiments, homologous recombination was used to disrupt the tez1 gene in *S. pombe* specifically. This approach is schematically illustrated in FIG. 65. As indicated in FIG. 65, wild type tez1 was replaced with a fragment containing the ura4 or LEU2 marker.

Figure 66:
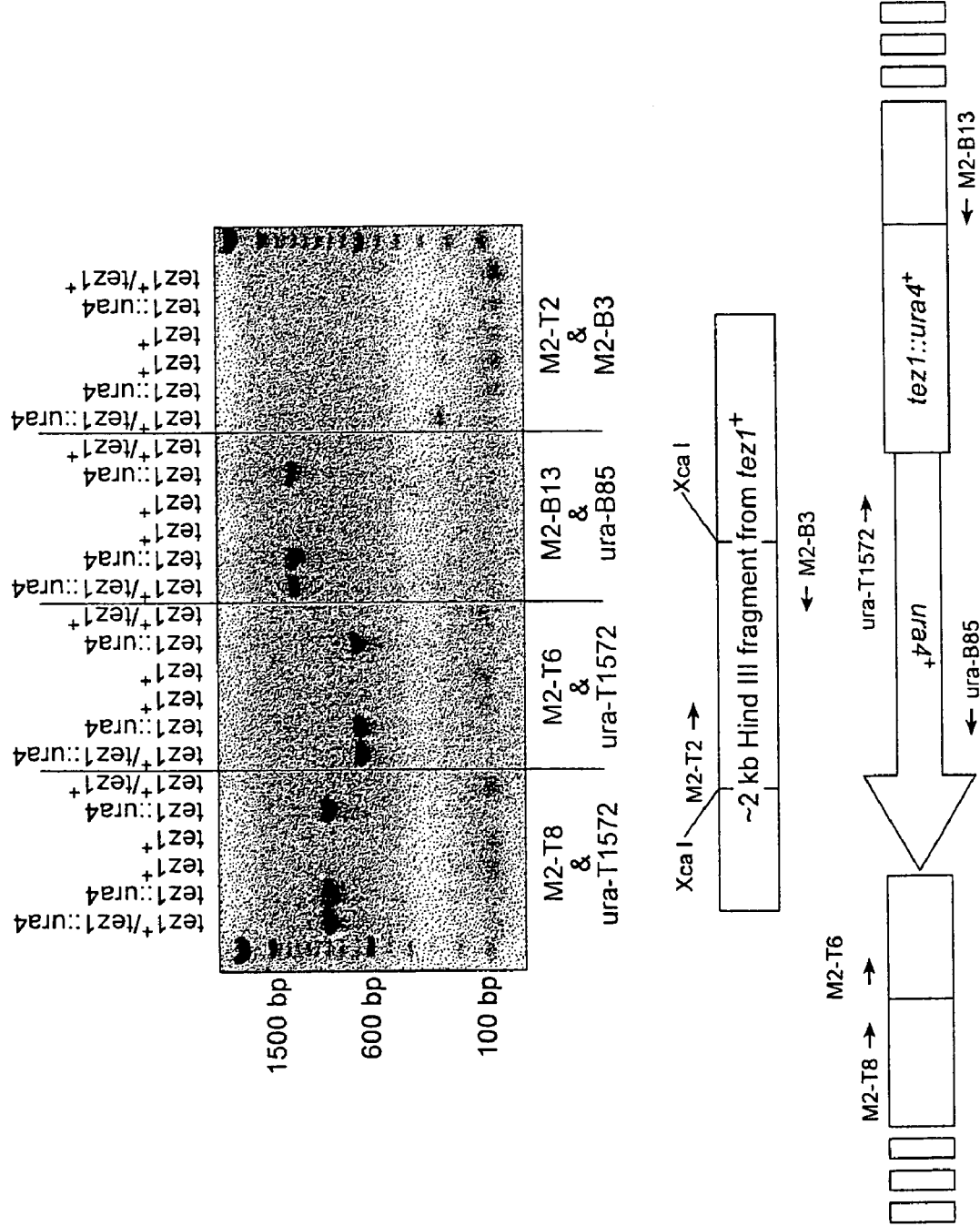
FIG. 66 shows the experimental results confirming disruption of tez1.
Figure 67:
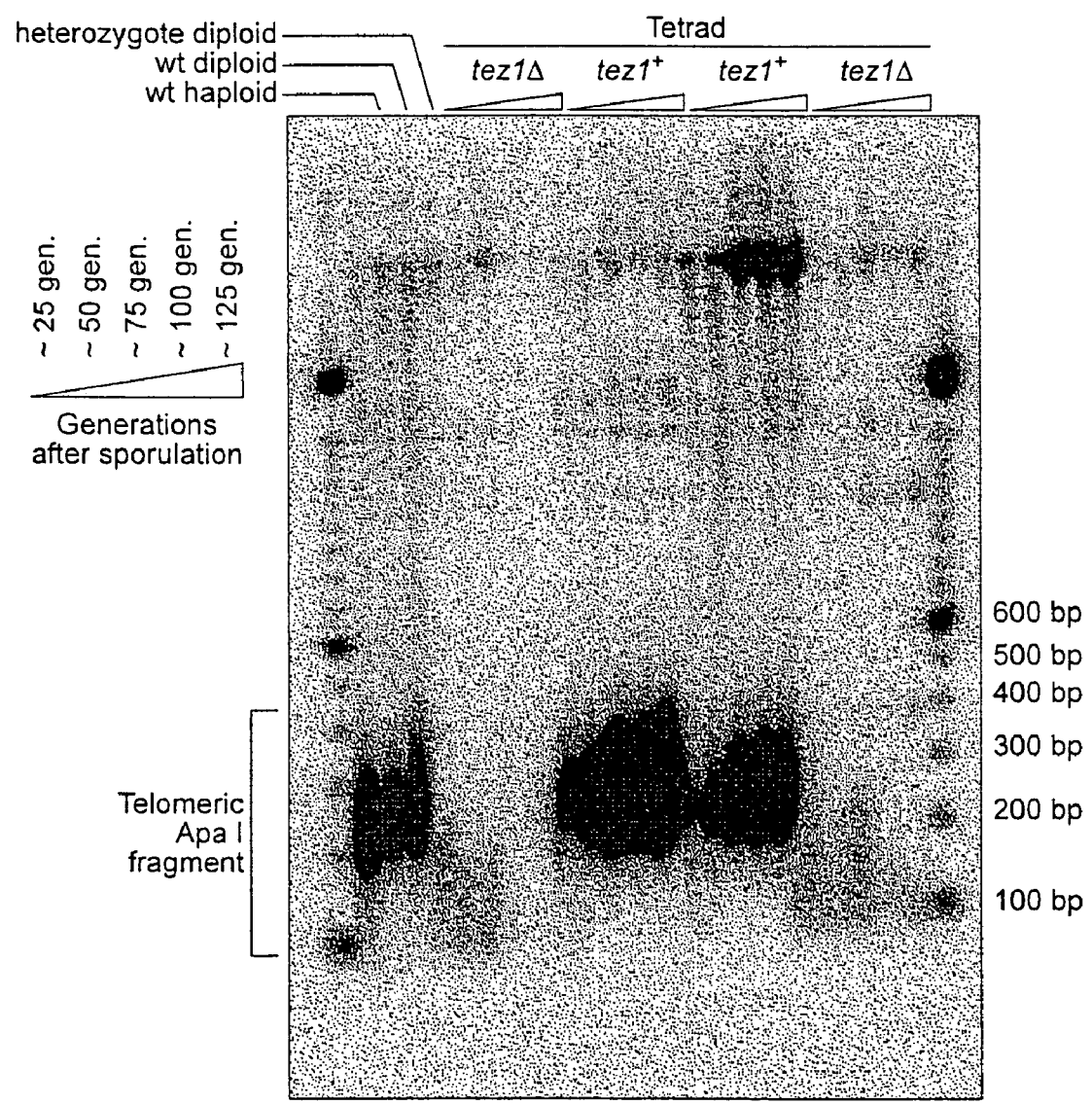
FIG. 67 shows the progressive shortening of telomeres in *S. pombe* due to tez1 disruption.

The disruption of tez1 gene was confirmed by PCR (FIG. 66), and a Southern blot was performed to check for telomere length. FIG. 67 shows the Southern blot results for this experiment. Because an ApaI restriction enzyme site is present immediately adjacent to telomeric sequence in *S. pombe*, ApaI digestion of *S. pombe* genomic DNA preparations permits analysis of telomere length. Thus, DNA from *S. pombe* was digested with ApaI and the digestion products were run on an agarose gel and probed with a telomeric sequence-specific probe to determine whether the telomeres of disrupted *S. pombe* cells were shortened. The results are shown in FIG. 67. From these results, it was clear that disruption of the tez1 gene caused a shortening of the telomeres.

Q. Cloning and Characterization of Human Telomerase Protein and cDNA

In this Example, the nucleic and amino acid sequence information for human telomerase was determined. Partial homologous sequences were first identified in a BLAST search conducted using the *Euplotes* 123 kDa peptide and nucleic acid sequences, as well as *Schizosaccharomyces* protein and corresponding cDNA (tez1) sequences. The human sequences (also referred to as "hTCP1.1") were identified from a partial cDNA clone (clone 712562). Sequences from this clone were aligned with the sequences determined as described in previous Examples.

Figure 52B:
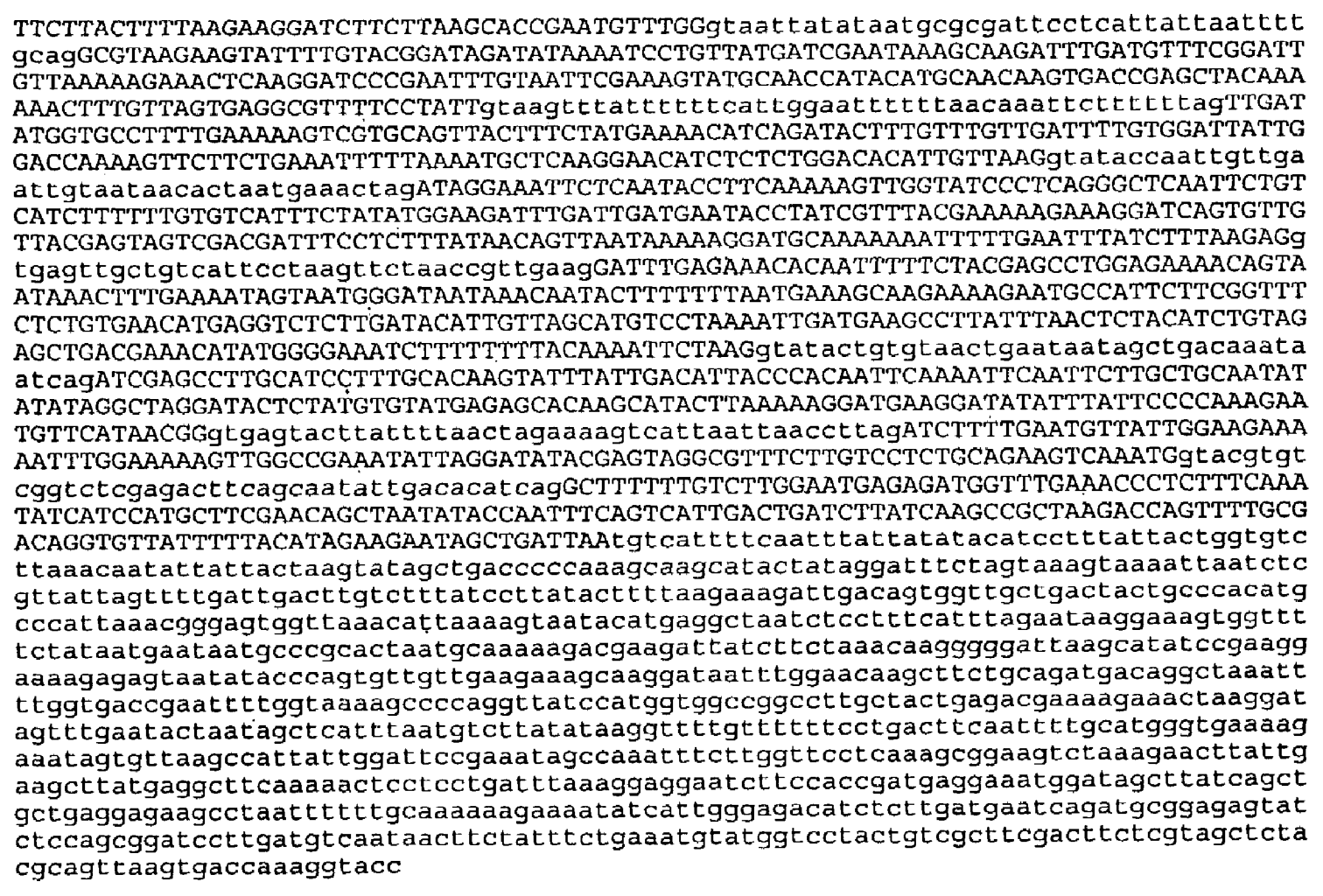

FIG. 1 shows the sequence alignment of the *Euplotes* ("p123"), *Schizosaccharomyces* ("tez1"), Est2p (i.e., the *S. cerevisiae* protein encoded by the Est2 nucleic acid sequence, and also referred to herein as "L8543.12"), and the human homolog identified in this comparison search. FIG. 51 shows the amino acid sequence of tez1, while FIG. 52 shows the DNA sequence of tez1. In FIG. 52, the introns and other non-coding regions, are shown in lower case, while the exons (i.e., coding regions) are shown in upper case.

As shown in the Figures, there are regions that are highly conserved among these proteins. For example, as shown in FIG. 1, there are regions of identity in "Motif 0," "Motif 1," "Motif 2," and "Motif 3," The identical amino acids are indicated with an asterisk (*), while the similar amino acid residues are indicated by a circle (●). This indicates that there are regions within the telomerase motifs that are conserved among a wide variety of eukaryotes, ranging from yeast to ciliates to humans. It is contemplated that additional organisms will likewise contain such conserved regions of sequence. FIG. 49 shows the partial amino acid sequence of the human telomerase motifs, while FIG. 50 shows the corresponding DNA sequence.

Sanger dideoxy sequencing and other methods were used, as known in the art to obtain complete sequence information of clone 712562. Some of the primers used in the sequencing are shown in Table 7. These primers were designed to hybridize to the clone, based on sequence complementarity to either plasmid backbone sequence or the sequence of the human cDNA insert in the clone.

TABLE 7

| Primer | Primers Sequence | SEQ ID NO: |
| --- | --- | --- |
| TCP1.1 | GTGAAGGCACTGTTCAGCG | 377 |
| TCP1.2 | GTGGATGATTTCTTGTTGG | 381 |
| TCP1.3 | ATGCTCCTGCGTTTGGTGG | 596 |
| TCP1.4 | CTGGACACTCAGCCCTTGG | 382 |
| TCP1.5 | GGCAGGTGTGCTGGACACT | 383 |
| TCP1.6 | TTTGATGATGCTGGCGATG | 384 |
| TCP1.7 | GGGGCTCGTCTTCTACAGG | 385 |
| TCP1.8 | CAGCAGGAGGATCTTGTAG | 386 |
| TCP1.9 | TGACCCCAGGAGTGGCACG | 387 |

TABLE 7-continued

| Primer | Primers Sequence | SEQ ID NO: |
| --- | --- | --- |
| TCP1.10 | TCAAGCTGACTCGACACCG | 388 |
| TCP1.11 | CGGCGTGACAGGGCTGC | 389 |
| TCP1.12 | GCTGAAGGCTGAGTGTCC | 390 |
| TCP1.13 | TAGTCCATGTTCACAATCG | 391 |

From these experiments, it was determined that the EcoRI-NotI insert of clone 712562 contains only a partial open reading frame for the human telomerase protein, although it may encode an active fragment of that protein. The open reading frame in the clone encodes an approximately 63 kD protein. The sequence of the longest open reading frame identified is shown in FIG. 68. The ORF begins at the ATG codon with the "met" indicated in the Figure. The poly A tail at the 3' end of the sequence is also shown. FIG. 69 shows a tentative, preliminary alignment of telomerase reverse transcriptase proteins from the human sequence (human Telomerase Core Protein 1, "Hs TCP1"), *E. aediculatus* p123 ("Ep p123"), *S. pombe* tez1 ("Sp Tez1"), *S. cerevisiae* EST2 ("Sc Est2"), and consensus sequence. In this Figure various motifs are indicated.

To obtain a full-length clone, probing of a cDNA library and 5'-RACE were used to obtain clones encoding portions of the previously uncloned regions. In these experiments, RACE (Rapid Amplification of cDNA Ends; See e.g., M. A. Frohman, "RACE: Rapid Amplification of cDNA Ends," in Innis et al. (eds), *PCR Protocols: A Guide to Methods and Applications* [1990], pp. 28-38; and Frohman et al., Proc. Natl. Acad. Sci., 85:8998-9002 [1988]) was used to generate material for sequence analysis. Four such clones were generated and used to provide additional 5' sequence information (pFWRP5, 6, 19, and 20).

In addition, human cDNA libraries (inserted into lambda) were probed with the EcoRI-NotI fragment of the clone. One lambda clone, designated "lambda 25-1.1" (ATCC accession #209024), was identified as containing complementary sequences. FIG. 75 shows a restriction map of this lambda clone. The human cDNA insert from this clone was subcloned as an EcoRI restriction fragment into the EcoRI site of commercially available phagemid pBluescriptIISK+ (Stratagene), to create the plasmid "pGRN121," which was deposited with the ATCC (ATCC accession #209016). Preliminary results indicated that plasmid pGRN121 contains the entire open reading frame (ORF) sequence encoding the human telomerase protein.

Figure 70:
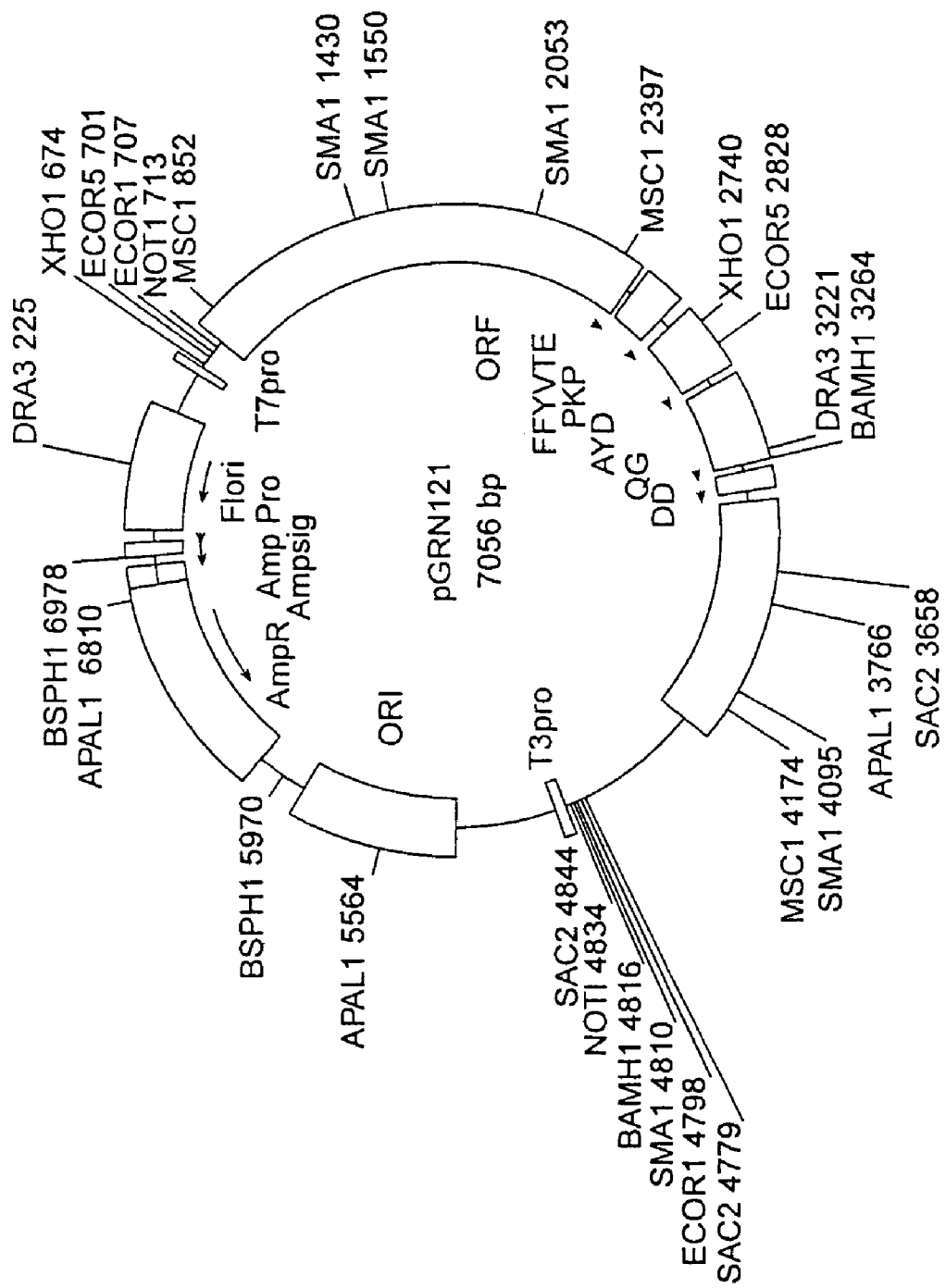
FIG. 70 provides a restriction and function map of plasmid pGRN121.
Figure 72E:
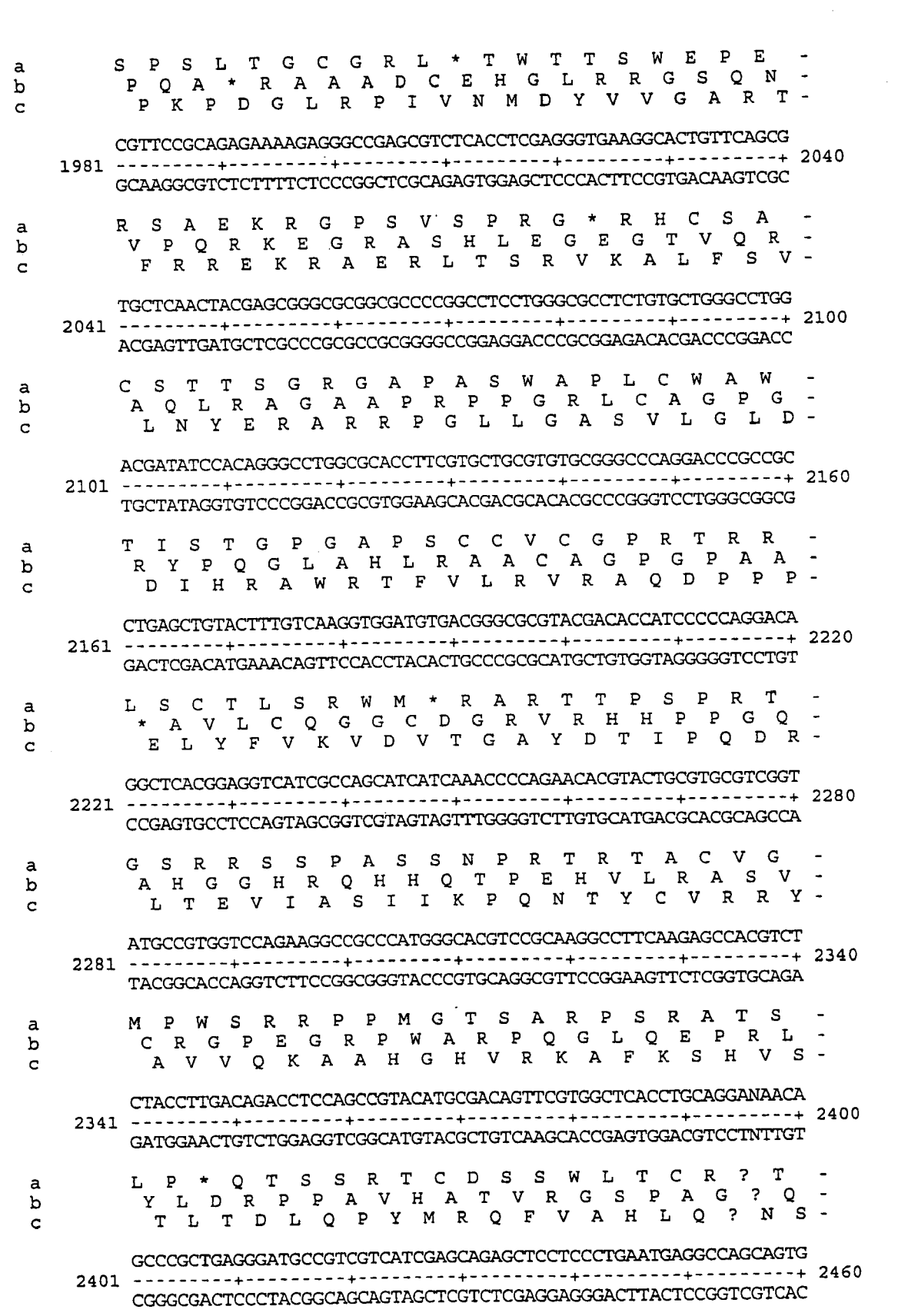
Figure 72G:
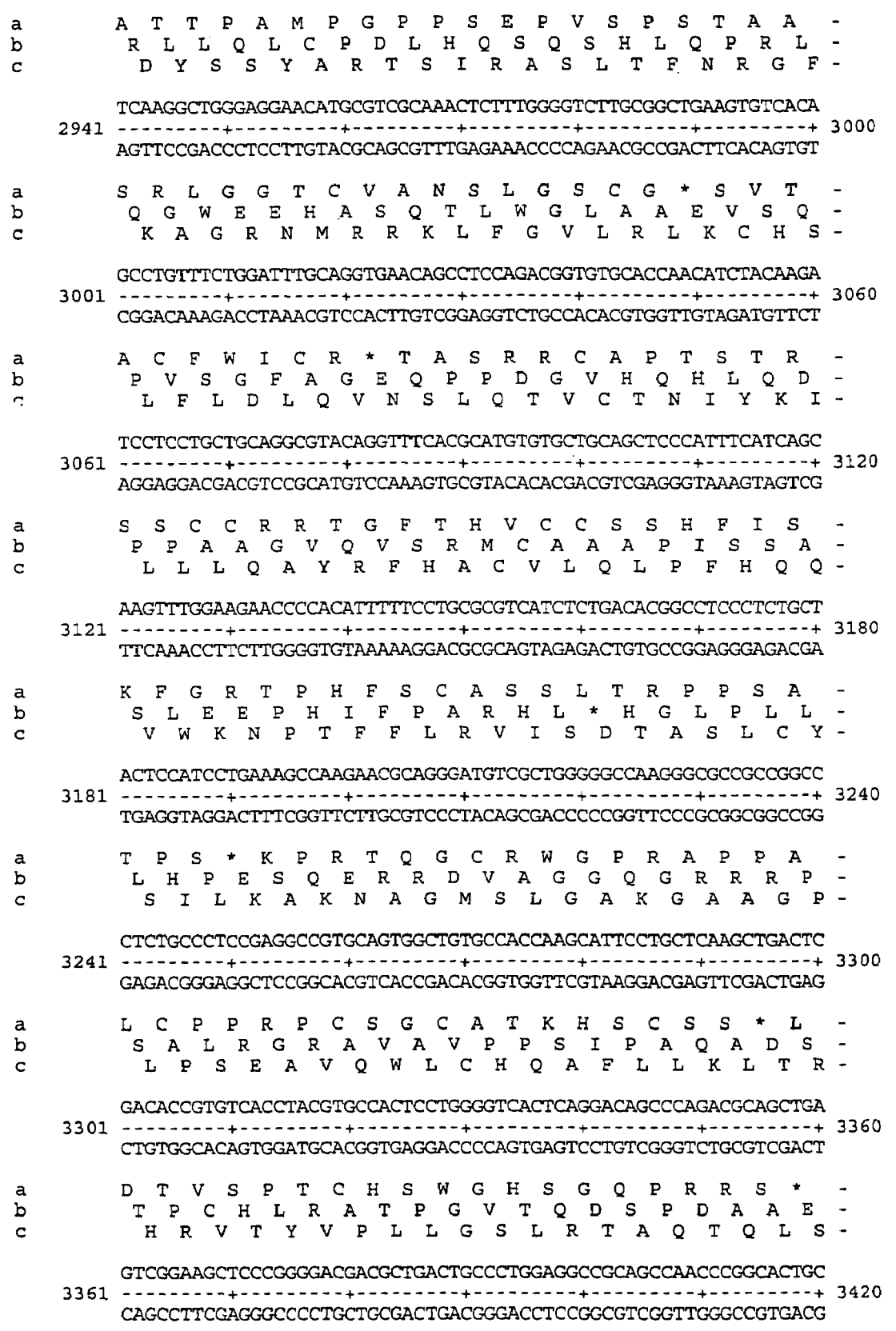
Figure 72H:
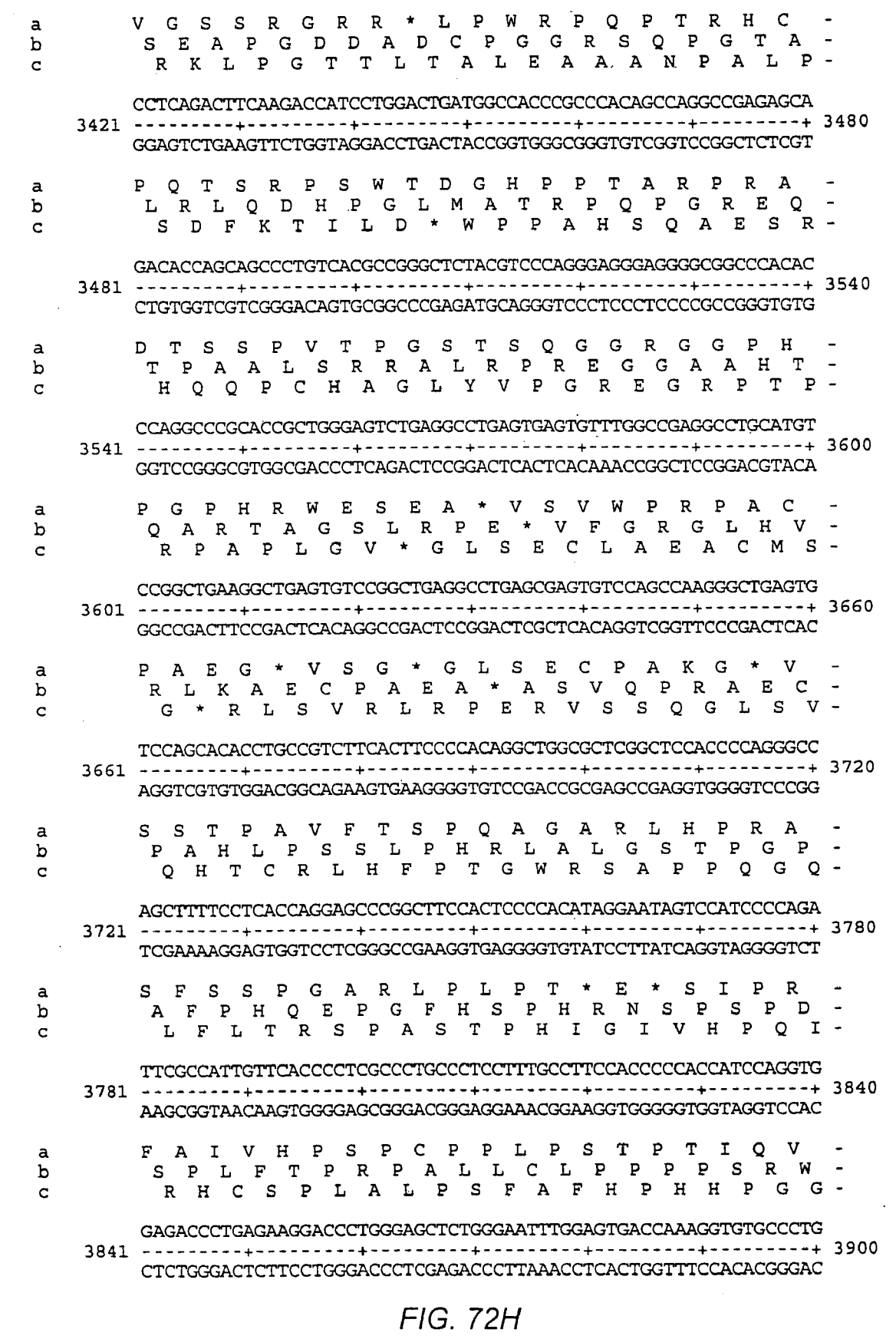
Figure 72I:
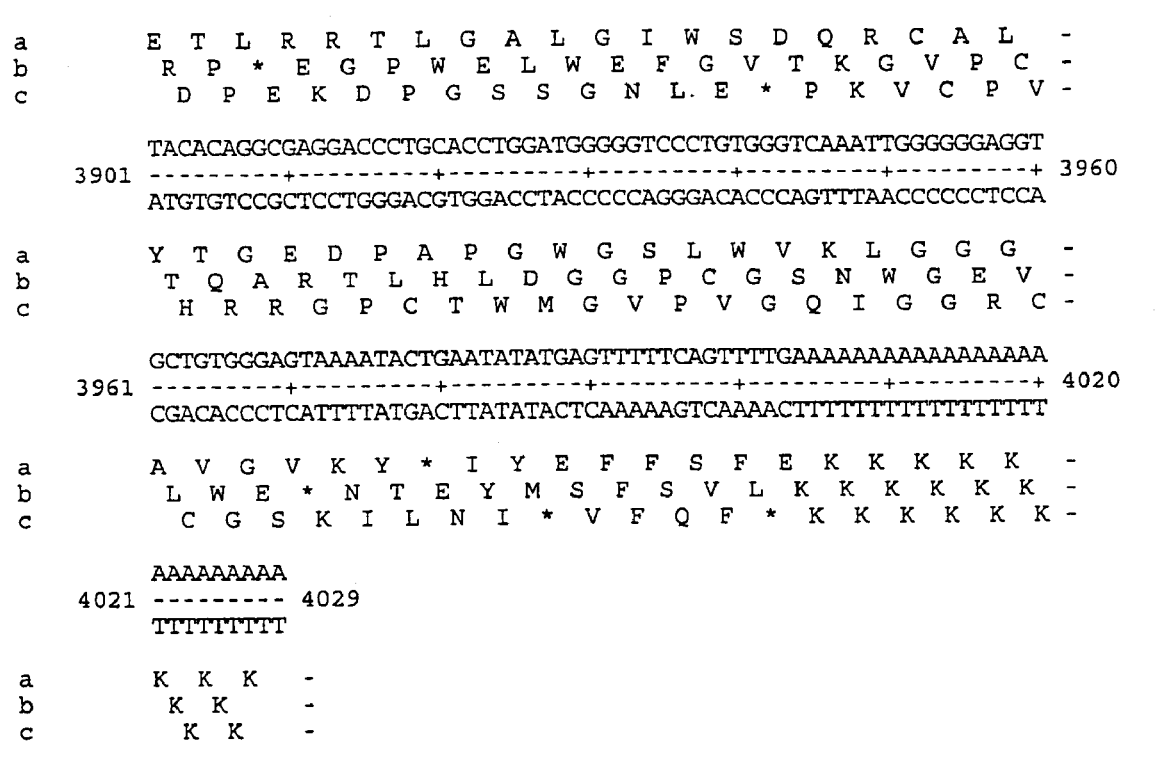

The cDNA insert of plasmid pGRN121 was sequenced using techniques known in the art. FIG. 70 provides a restriction site and function map of plasmid pGRN121 identified based on this preliminary work. The results of this preliminary sequence analysis are shown in FIG. 71. From this analysis, and as shown in FIG. 70, a putative start site for the coding region was identified at approximately 50 nucleotides from the EcoRI site (located at position 707), and the location of the telomerase-specific motifs, "FFYVTE" (SEQ ID NO:361), "PKP," "AYD," "QG", and "DD," were identified, in addition to a putative stop site at nucleotide #3571 (See, FIG. 72, which shows the DNA and corresponding amino acid sequences for the open reading frames in the sequence ("a", "b", and "c")). However, due to the preliminary nature of the early sequencing work, the reading frames for the various motifs were found not to be in alignment.

Additional analysis conducted on the pGRN121 indicated that the plasmid contained significant portions from the 5'-end of the coding sequence not present on clone 712562. Furthermore, pGRN121 was found to contain a variant coding sequence that includes an insert of approximately 182 nucleotides. This insert was found to be absent from the clone. As with the *E. aediculatus* sequences, such variants can be tested in functional assays, such as telomerase assays to detect the presence of functional telomerase in a sample.

Figure 73:
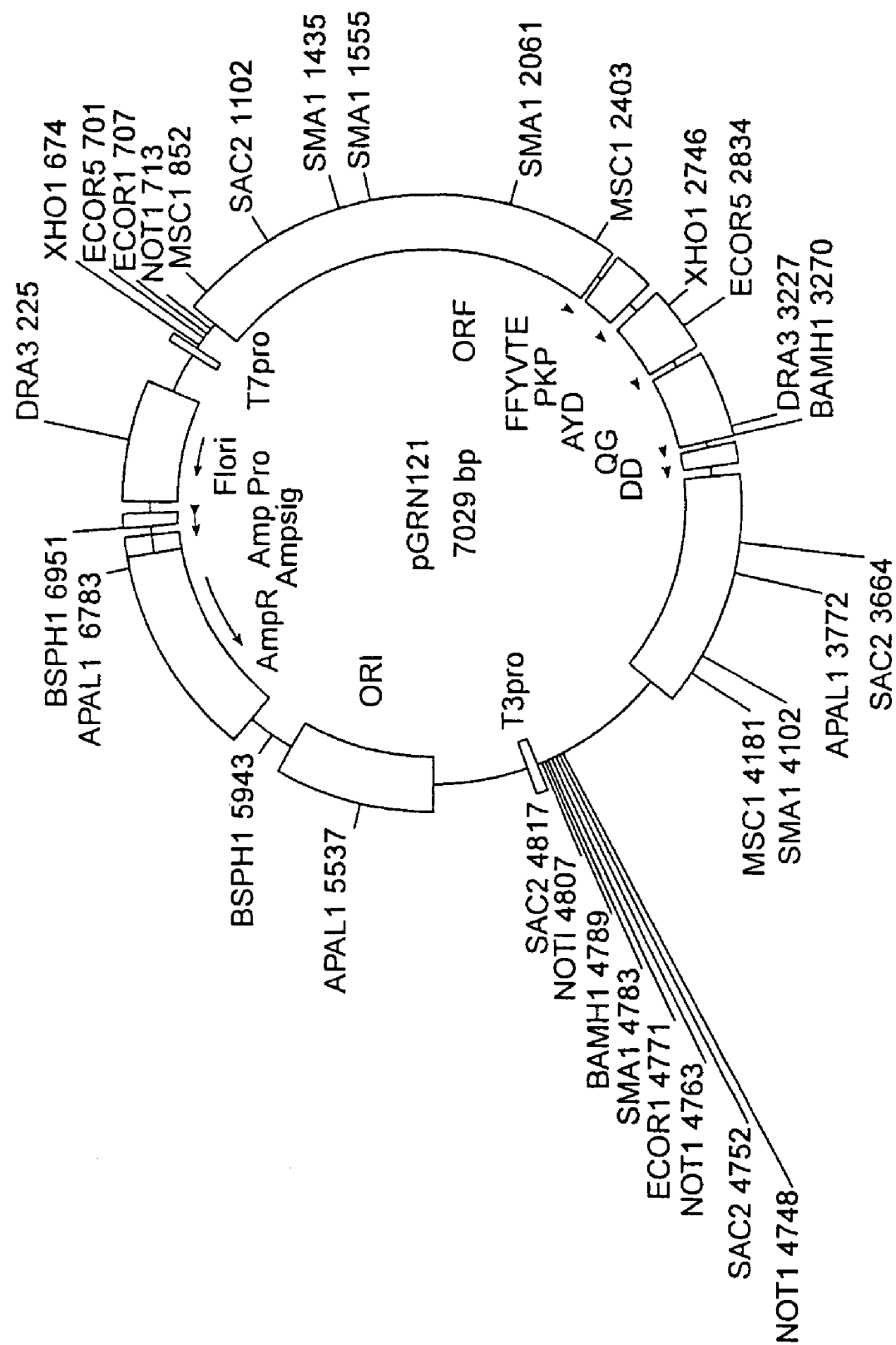
FIG. 73 provides a restriction and function map of plasmid pGRN121.

Further sequence analysis resolved the cDNA sequence of pGRN121 to provide a contiguous open reading frame that encodes a protein of molecular weight of approximately 127,000 daltons, and 1132 amino acids as shown in FIG. 74. A refined map of pGRN121 based on this analysis, is provided in FIG. 73. The results of additional sequence analysis of the hTRT cDNA are presented in FIG. 16 SEQ ID NO:1.

Example 2

Correlation of hTRT Abundance and Cell Immortality

Figure 5:
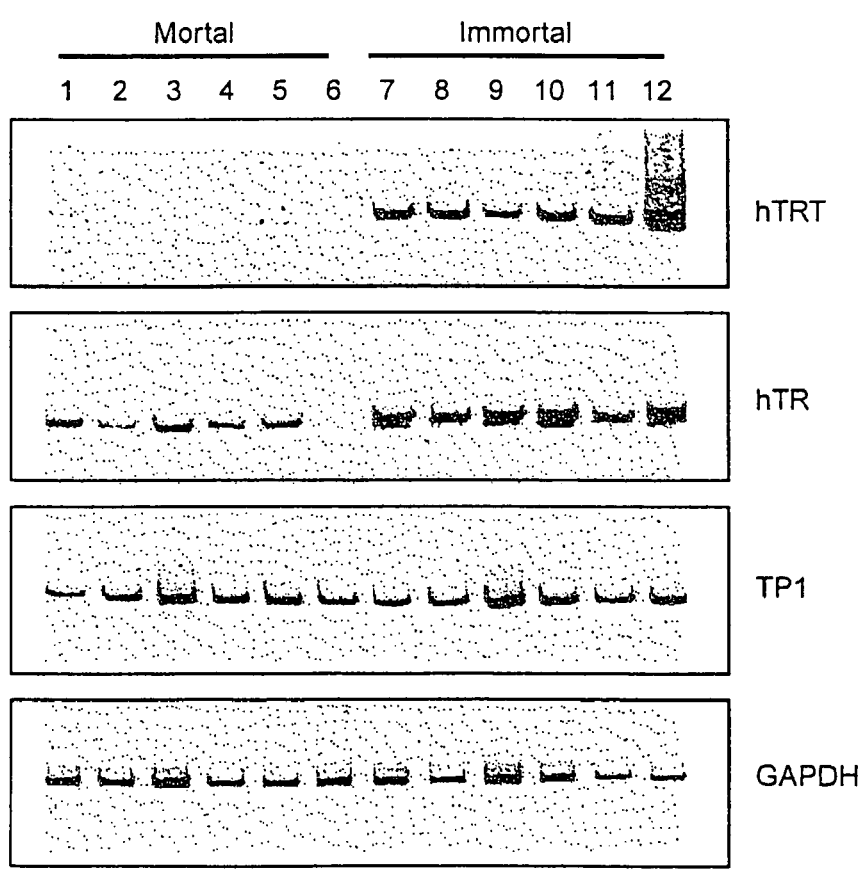
FIG. 5 shows expression of hTRT RNA in telomerase-negative mortal cell strains and telomerase-positive immortal cell lines as described in Example 2.

The relative abundance of hTRT mRNA was assessed in six telomerase-negative mortal cell strains and six telomerase-positive immortal cell lines (FIG. 5). The steady state level of hTRT mRNA was significantly increased in immortal cell lines that had previously been shown to have active telomerase. Lower levels of the hTRT mRNA were detected in some telomerase-negative cell strains.

RT-PCR for hTRT, hTR, TP1 (telomerase-associated protein related to *Tetrahymena* p80 [Harrington et al., 1997, *Science* 275:973; Nakayama et al., 1997, *Cell* 88:875]) and GAPDH (to normalize for equal amounts of RNA template) was carried out on RNA derived from the following cells: (1) human fetal lung fibroblasts GFL, (2) human fetal skin fibroblasts GFS, (3) adult prostate stromal fibroblasts 31 YO, (4) human fetal knee synovial fibroblasts HSF, (5) neonatal foreskin fibroblasts BJ, (6) human fetal lung fibroblasts LMR90, and immortalized cell lines: (7) melanoma LOX IMVI, (8) leukemia 251, (9) NCI H23 lung carcinoma, (10) colon adenocarcinoma SW620, (11) breast tumor MCF7, (12) 293 adenovirus E1 transformed human embryonic kidney cell line.

hTRT nucleic acid was amplified from cDNA using oligonucleotide primers Lt5 and Lt6 (Table 2) for a total of 31 cycles (94° C. 45s, 60° C. 45s, 72° C. 90s). GAPDH was amplified using primers K136 (5'-CTCAGACACCATGGG-GAA GGTGA; SEQ ID NO:552) and K137 (5'-ATGATCT-TGAGGCTGTTGTCATA; SEQ ID NO:553) for a total of 16 cycles (94° C. 45 s, 55° C. 45 s, 72° C. 90 s). hTR was amplified using primers F3b (5'-TCTAACCCTAACT-GAGAAGGGCGTAG; SEQ ID NO:597) and R3c (5'-GTTTGCTCTAGAATGAACGGTGGAAG; SEQ ID NO:598) for a total of 22 cycles (94° C. 45s, 55° C. 45 s, 72° C. 90s). TP1 mRNA was amplified using primers TP1.1 and TP1.2 for 28 cycles (cycles the same as hTRT). Reaction products were resolved on an 8% polyacrylamide gel, stained with SYBR Green (Molecular Probes) and visualized by scanning on a Storm 860 (Molecular Dynamics). The results, shown in FIG. 5, demonstrate that hTRT mRNA levels correlate directly with telomerase activity levels in the cells tested.

Example 3

Characterization of an hTRT Intronic Sequence

A putative intron was first identified by PCR amplification of human genomic DNA, as described in this example, and subsequently confirmed by sequencing the genomic clone λGø5 (see Example 4). PCR amplification was carried out using the forward primer TCP1.57 paired individually with the reverse primers TCP1.46, TCP1.48, TCP1.50, TCP1.52, TCP1.54, TCP1.56, and TCP1.58 (see Table 2). The products from genomic DNA of the TCP1.57/TCP1.46, TCP1.48, TCP1.50, TCP1.52, TCP1.54, or TCP1.56 amplifications were approximately 100 basepairs larger than the products of the pGRN121 amplifications. The TCP1.57/TCP1.58 amplification was the same on either genomic or pGRN121 DNA. This indicated the genomic DNA contained an insertion between the sites for TCP1.58 and TCP1.50. The PCR products of TCP1.57/TCP1.50 and TCP1.57/TCP1.52 were sequenced directly, without subcloning, using the primers TCP1.39, TCP1.57, and TCP1.49.

As shown below, the 104-base intronic sequence SEQ ID NO:7 is inserted in the hTRT mRNA (shown in bold) at the junction corresponding to bases 274 and 275 of FIG. 16:

CCCCCCGCCGCCCCCTCCTTCCGCCAG/GTGGGCCTCCCCGGGGTCGGCGTCCG

GCTGGGGTTGAGGGCGGCCGGGGGGAACCAGCGACATGCGGAGAGCAGCGCAG

GCGACTCAGGGCGCTTCCCCCGCAG/GTGTCCTGCCTGAAGGAGCTGGTGGCC

CGAGTGCTGCAG (SEQ ID NO:599)

The "/" indicates the splice junctions; the sequence shows good matches to consensus 5' and 3' splice site sequences typical for human introns.

This intron contains motifs characteristic of a topoisomerase II cleavage site and a NFκB binding site (see FIG. 21). These motifs are of interest, in part, because expression of topoisomerase II is up regulated in most tumors. It functions to relax DNA by cutting and rewinding the DNA, thus increasing expression of particular genes. Inhibitors of topoisomerase II have been shown to work as anti-tumor agents. In the case of NFκB, this transcription factor may play a role in regulation of telomerase during terminal differentiation, such as in early repression of telomerase during development and so is another target for therapeutic intervention to regulate telomerase activity in cells.

Example 4

Cloning of Lambda Phage GΦ5 and Characterization of hTRT Genomic Sequences

A. Lambda GΦ5

A human genomic DNA library was screened by PCR and hybridization to identify a genomic clone containing hTRT RNA coding sequences. The library was a human fibroblast genomic library made using DNA from WI38 lung fibroblast cells (Stratagene, Cat # 946204). In this library, partial Sau3AI fragments are ligated into the XhoI site of Lambda FIX7II Vector (Stratagene), with an insert size of 9-22 kb.

The genomic library was divided into pools of 150,000 phage each, and each pool screened by nested PCR (outer primer pair TCP1.52 & TCP1.57; inner pair TCP1.49 & TCP1.50, see Table 1). These primer pairs span a putative intron (see Example 3, supra) in the genomic DNA of hTRT and ensured the PCR product was derived from a genomic source and not from contamination by the hTRT cDNA clone. Positive pools were further subdivided until a pool of 2000 phage was obtained. This pool was plated at low density and screened via hybridization with a DNA fragment encompassing basepairs 1552-2108 of FIG. 16 (restriction sites SphI and EcoRV, respectively).

Two positive clones were isolated and rescreened via nested PCR as described above; both clones were positive by PCR. One of the clones (λGΦ5) was digested with NotI, revealing an insert size of approximately 20 kb. Subsequent mapping (see below) indicated the insert size was 15 kb and that phage GΦ5 contains approximately 13 kb of DNA upstream from the start site of the cDNA sequence.

Figure 7:
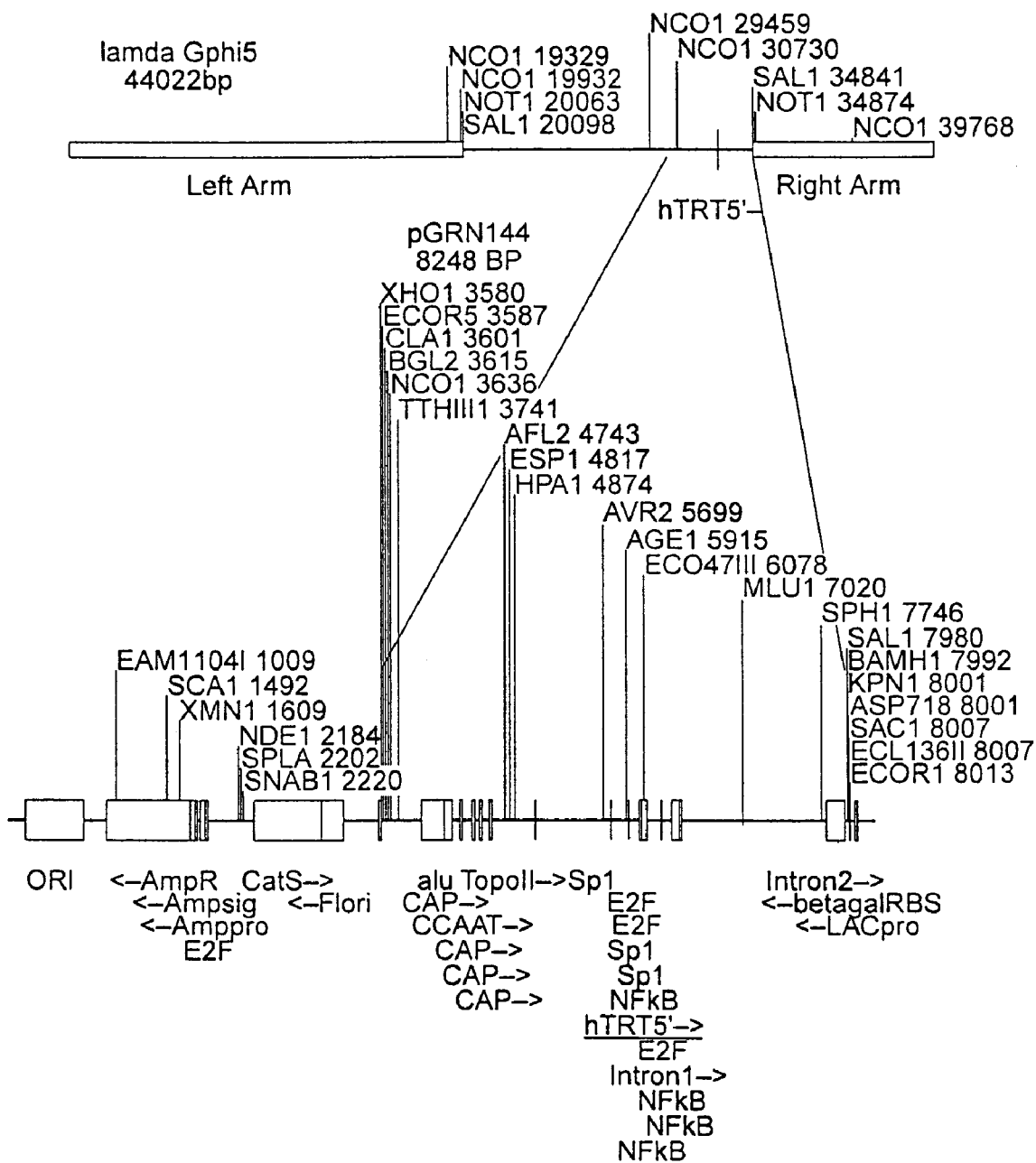
FIG. 7 shows a restriction map of lambda clone Gø5.

Phage GΦ5 was mapped by restriction enzyme digestion and DNA sequencing. The resulting map is shown in FIG. 7. The phage DNA was digested with NcoI and the fragments cloned into pBBS 167. The resulting subclones were screened by PCR to identify those containing sequence corresponding to the 5' region of the hTRT cDNA. A subclone (pGRN140) containing a 9 kb NcoI fragment (with hTRT gene sequence and 4-5 kb of lambda vector sequence) was partially sequenced to determine the orientation of the insert. pGRN 140 was digested using SalI to remove lambda vector sequences, resulting in pGRN144. pGRN144 was then sequenced. The results of the sequencing are provided in FIG. 21. The 5' end of the hTRT mRNA corresponds to base 2441 of FIG. 21. As indicated in FIG. 7, two Alu sequence elements are located 1700 base pairs upstream of the hTRT cDNA 5' end and provide a likely upstream limit to the promoter region of hTRT. The sequence also reveals an intron positioned at bases 4173 in FIG. 21, 3' to the intron described in Example 3, supra.

B. Additional Genomic Clones

In addition to the genomic clone described above, two P1 bacteriophage clones and one human BAC clone are provided as illustrative embodiments of the invention. P1 inserts are usually 75-100 kb, and BAC inserts are usually over 100 Kb.

The P1 clones (DMPC-HFF#1-477(F6)-GS #15371 and DMPC-HEF#1-1103(H6)-GS #15372) were obtained by PCR screening of a human P1 library derived from human foreskin fibroblast cells (Shepherd et al., 1994, *PNAS USA* 91:2629) using primers TCP1.12 and UTR2 which amplify the 3' end of hTRT. These clones were both negative (failed to amplify) with primers that amplify the 5' end of hTRT.

The human BAC clone (326 E 20) was obtained with a hybridization screen of a BAC human genomic library using an 1143 bp Sph1/Xmn1 fragment of pGRN121 (FIG. 16; bases 1552-2695) that encompasses the RT motif region. The clone is believed to include the 5' end of the gene. The hTRT genomic clones in this example are believed to encompass the entire hTRT gene.

Example 5

Chromosomal Location of hTRT Gene

The hTRT gene was localized to chromosome 5p by radiation hybrid mapping (Boehnke et al., 1991, *Am J Hum Genet* 49:1174; Walter et al., 1994, *Nature Genet* 7:22) using the medium resolution Stanford G3 panel of 83 RH clones of the whole human genome (created at the Stanford Human Genome Center). A human lymphoblastoid cell line (donor; rM) was exposed to 10,000 rad of x-rays and was then fused with nonirradiated hamster recipient cells (A3). Eighty-three independent somatic cell hybrid clones were isolated, and each represents a fusion event between an irradiated donor cell and a recipient hamster cell. The panel of G3 DNA was used for ordering markers in the region of interest as well as establishing the distance between these markers.

The primers used for the RH mapping were TCP1.12 and UTR2 with amplification conditions of 94° C. 45 sec, 55° C. 45 sec, 72° C. 45 sec, for 45 cycles using Boehringer Mannheim Taq buffer and Perkin-Elmer Taq. The 83 pools were amplified independently and 14 (17%) scored positive for hTRT (by appearance of a 346 bp band). The amplification results were submitted to Stanford RH server, which then provided the map location, 5p, and the closest marker, STS D5S678.

By querying the Genethon genome mapping web site, the map location identified a YAC that contains the STS marker D5S678: CEPH YAC 780_C_3 Size: 390,660 kb. This YAC also contained chromosome 17 markers. This result indicated that the hTRT gene is on chromosome 5, near the telomeric end. There are increased copy numbers of 5p in a number of tumors. Cri-du-chat syndrome also has been mapped to deletions in this region.

Example 6

Design and Construction of Vectors for Expression of hTRT Proteins and Polynucleotides Expression of hTRT in Bacteria The following portion of this example details the design of hTRT-expressing bacterial and eukaryotic cell expression vectors to produce large quantities of full-length, biologically active hTRT. Generation of biologically active hTRT protein in this manner is useful for telomerase reconstitution assays, assaying for telomerase activity modulators, analysis of the activity of newly isolated species of hTRT, identifying and isolating compounds which specifically associate with hTRT, analysis of the activity of an hTRT variant protein that has been site-specifically mutated, and as an immunogen, as a few examples.

pThioHis A/hTRT Bacterial Expression Vector

To produce large quantities of full-length hTRT, the bacterial expression vector pThioHis A (Invitrogen, San Diego, Calif.) was selected as an expression system. The hTRT-coding insert includes nucleotides 707 to 4776 of the hTRT insert in the plasmid pGRN121. This nucleotide sequence includes the complete coding sequence for the hTRT protein.

This expression vector of the invention is designed for inducible expression in bacteria. The vector can be induced to express, in *E. Coli*, high levels of a fusion protein composed of a cleavable, HIS tagged thioredoxin moiety and the full length hTRT protein. The use of the expression system was in substantial accordance with the manufacturer's instructions. The amino acid sequence of the fusion protein encoded by the resulting vector of the invention is shown below; (-*-) denotes an enterokinase cleavage site:

```
MSDKIIHLTDDSFDTDVLKADGAILVDFWAHWCGPCKMIAPILDEIADEYQGKLTVAKLRID

HNPGTAPKYGIRGIPTLLLFKNGEVAATKVGALSKGQLKEFLDANLAGSGSGDDDDK-*-VP

MHELEIFEFAAASTQRCVLLRTWEALAPATPAMPRAPRCRAVRSLLRSHYREVLPLATFVRR

LGPQGWRLVQRGDPAAFRALVAQCLVCVPWDARPPPAAPSFRQVSCLKELVARVLQRLCERG

AKNVLAFGFALLDGARGGPPEAFTTSVRSYLPNTVTDALRGSGAWGLLLRRVGDDVLVHLLA

RCALFVLVAPSCAYQVCGPPLYQLGAATQARPPPHASGPRRRLGCERAWNHSVREAGVPLGL

PAPGARRRGGSASRSLPLPKRPRRGAAPEPERTPVGQGSWAHPGRTRGPSDRGFCVVSPARP

AEEATSLEGALSGTRHSHPSVGRQHHAGPPSTSRPPRPWDTPCPPVYAETKHFLYSSGDKEQ

LRPSFLLSSLRPSLTGARRLVETIFLGSRPWMPGTPRRLPRLPQRYWQMRPLFLELLGNHAQ

CPYGVLLKTHCPLRAAVTPAAGVCAREKPQGSVAAPEEEDTDPRRLVQLLRQHSSPWQVYGF

VRACLRRLVPPGLWGSRHNERRFLRNTKKFISLGKHAKLSLQELTWKMSVRDCAWLRRSPGV

GCVPAAEHRLREEILAKFLHWLMSVYVVELLRSFFYVTETTFQKNRLFFYRKSVWSKLQSIG

IRQHLKRVQLRELSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQDPPPELYFVKVD

VTGAYDTIPQDRLTEVIASIIKPQNTYCVRRYAVVQKAAHGHVRKAFKSHVSTLTDLQPYMR

QFVAHLQETSPLRDAVVIEQSSSLNEASSGLFDVFLRFMCHHAVRIRGKSYVQCQGIPQGSI

LSTLLCSLCYGDMENKLFAGIRRDGLLLRLVDDFLLVTPHLTHAKTFLRTLVRGVPEYGCVV

NLRKTVVNFPVEDEALGGTAFVQMPAHGLFPWCGLLLDTRTLEVQSDYSSYARTSIRASLTF

NRGFKAGRNMRRKLFGVLRLKCHSLFLDLQVNSLQTVCTNIYKILLLQAYRFHACVLQLPFH

QQVWKNPTFFLRVISDTASLCYSILKAKNAGMSLGAKGAAGPLPSEAVQWLCHQAFLLKLTR

HRVTYVPLLGSLRTAQTQLSRKLPGTTLTALEAAANPALPSDFKTILD (SEQ ID NO:600)
``` pGEX-2TK with hTRT Nucleotides 3272 to 4177 of pGRN121

This construct of the invention is used to produce fusion protein for, e.g., the purpose of raising polyclonal and monoclonal antibodies to hTRT protein. Fragments of hTRT can also be used for other purposes, such as to modulate telomerase activity, for example, as a dominant-negative mutant or to prevent the association of a telomerase component with other proteins or nucleic acids.

To produce large quantities of an hTRT protein fragment, the E. coli expression vector pGEX-2TK (Pharmacia Biotech, Piscataway N.J.) was selected, and used essentially according to manufacturer's instructions to make an expression vector of the invention. The resulting construct contains an insert derived from nucleotides 3272 to 4177 of the hTRT insert in the plasmid pGRN121. The vector directs expression in E. coli of high levels of a fusion protein composed of glutathione-5-transferase sequence (underlined below), thrombin cleavage sequence (double underlined), recognition sequence for heart muscle protein kinase (italicized), residues introduced by cloning in brackets ([GSVTK]; SEQ ID NO:601) and hTRT protein fragment (in bold) as shown below:

```
MSPILGYWKIKGLVQPTRLLLEYLEEKYEEHLYERDEGDKWRNKKFELGLEFPNLPYYIDGD

VKLTQSMAIIRYIADKHNMLGGCPKERAEISMLEGAVLDIRYGVSRIAYSKDFETLKVDFLS

KLPEMLKMFEDRLCHKTYLNGDHVTHPDFMLYDALDVVLYMDPMCLDAFPKLVCFKKRIEAI

PQIDKYLKSSKYIAWPLQGWQATFGGGDHPPKSDLVPRGSRRASV[GSVTK]IPQGSILSTL

LCSLCYGDMENKLFAGIRRDGLLLRLVDDFLLVTPHLTHAKTFLRTLVRGVPEYGCVVNLRK

TVVNFPVEDEALGGTAFVQMPAHGLFPWCGLLLDTRTLEVQSDYSSYARTSIRASVTFNRGF

KAGRNMRRKLFGVLRLKCHSLFLDLQVNSLQTVCTNIYKILLLQAYRFHACVLQLPFHQQVW

KNPTFFLRVISDTASLCYSILKAKNAGMSLGAKGAAGPLPSEAVQWLCHQAFLLKLTRHRVT

YVPLLGSLRTAQTQLSRKLPGTTLTALEAAANPALPSDFKTILD (SEQ ID NO:602)
```

When this fusion protein was expressed, it formed insoluble aggregates. It was treated generally as described above, in the section entitled purification of proteins from inclusion bodies. Specifically, induced cells were suspended in PBS (20 mM sodium phosphate, pH 7.4, 150 mM NaCl) and disrupted by sonication. NP-40 was added to 0.1%, and the mixture was incubated for 30 minutes at 4° C. with gentle mixing. The insoluble material was collected by centrifugation at 25,000 g for 30 minutes at 4° C. The insoluble material was washed once in 4M urea in PBS, collected by centrifugation, then washed again in PBS. The collected pellet was estimated to contain greater than 75% fusion protein. This material was dried in a speed vacuum, then suspended in adjuvant for injection into mice and rabbits for the generation of antibodies. Separation of the recombinant protein from the glutathione S-transferase moiety is accomplished by site-specific proteolysis using thrombin according to manufacturer's instructions.

pGEX-2TK with hTRT Nucleotides 2426 to 3274 of pGRN121 with HIS-8 Tag

To produce large quantities of a fragment of hTRT, another *E. coli* expression vector pGEX-2TK construct was prepared. This construct contains an insert derived from nucleotides 2426 to 3274 of the hTRT insert in the plasmid pGRN121 and a sequence encoding eight consecutive histidine residues (HIS-8 Tag). To insert the HIS-8 TAG, the pGEX-2TK vector with hTRT nucleotides 2426 to 3274 of pGRN121 was linearized with BamH1. This opened the plasmid at the junction between the GST-thrombin-heart muscle protein kinase and the hTRT coding sequence. A double stranded oligonucleotide with BamH1 compatible ends was ligated to the linearized plasmid resulting in the in-frame introduction of eight histidine residues upstream of the hTRT sequence.

The vector directs expression in *E coli* of high levels of a fusion protein composed of glutathione-5-transferase sequence (underlined); thrombin cleavage sequence (double underlined); recognition sequence for heart muscle protein kinase (italicized); a set of three and a set of five residues introduced by cloning are in brackets ([GSV] and [GSVTK] SEQ ID NO:601); eight consecutive histidines (also double underlined); and hTRT protein fragment (in bold):

Each of the pGEX-2TK vectors of the invention can be used to produce fusion protein for the purpose of raising polyclonal and monoclonal antibodies to hTRT protein. Additionally, this fusion protein can be used to affinity purify antibodies raised to hTRT peptides that are encompassed within the fusion protein. Separation of the recombinant protein from the glutathione S-transferase moiety can be accomplished by site-specific proteolysis using thrombin according to manufacturer's instructions.

pGEX-2TK with hTRT Nucleotides 2426 to 3274 of pGRN121, no HIS-8 Tag

To produce large quantities of a fragment of hTRT, another *E. coli* expression vector pGEX-2TK construct was prepared.

This construct contains an insert derived from nucleotides 2426 to 3274 of the hTRT insert in the plasmid pGRN121, but without the HIS-8 tag of the construct described above. The vector directs expression in *E coli* of high levels of a fusion protein composed of glutathione-5-transferase (underlined), thrombin cleavage sequence (double underlined), recognition sequence for heart muscle protein kinase (italicized), residues introduced by cloning in brackets ([GSVTK]; SEQ ID NO:601) and hTRT protein fragment (in bold):

<u>MSPILGYWKIKGLVQPTRLLLEYLEEKYEEHLYERDEGDKWRNKKFELGLEFPNLPY</u>

<u>YIDGDVKLTQSMAIIRYIADKHNMLGGCPKERAEISMLEGAVLDIRYGVSRIAYSKDF</u>

<u>ETLKVDFLSKLPEMLKMFEDRLCHKTYLNGDHVTHPDFMLYDALDVVLYMDPMCL</u>

<u>DAFPKLVCFKKRIEAIPQIDKYLKSSKYIAWPLQGWQATFGGGDHPPKSD<u>LVPRGS</u></u>RR

*ASV*[GSV]<u>HHHHHHHH</u>[GSVTK]MSVYVVELLRSFFYVTETTFQKNRLFFYRPSVWS

KLQSIGIRQHLKRVQLRELSEAEVRQHREARPALLTSRLRFIPKPDGLRPIVNMD

YVVGARTFRREKRAERLTSRVKALFSVLNYERARRPGLLGASVLGLDDIHRAW

RTFVLRVRAQDPPPELYFVKVDVTGAYDTIPQDRLTEVIASIIKPQNTYCVRRYA

VVQKAAHGHVRKAFKSHVSTLTDLQPYMRQFVAHLQETSPLRDAVVIEQSSSLN

EASSGLFDVFLRFMCHHAVRIRGKSYVQCQGI (SEQ ID NO:603)

MSPILGYWKIKGLVQPTRLLLEYLEEKYEEHLYERDEGDKWRNKKFELGLEFPNLPYYIDGD

VKLTQSMAIIRYIADKHNMLGGCPKERAEISMLEGAVLDIRYGVSRIAYSKDFETLKVDFLS

KLPEMLKMFEDRLCHKTYLNGDHVTHPDFMLYDALDVVLYMDPMCLDAFPKLVCFKKRIEAI

PQIDKYLKSSKYIAWPLQGWQATFGGGDHPPKSDLVPRGS*RRASV*[GSVTK]MSVYVVELLR

SFFYVTETTFQKNRLFFYRPSVWSKLQSIGIRQHLKRVQLRELSEAEVRQHREARPALLTSR

LRFIPKPDGLRPIVNMDYVVGARTFRREKRAERLTSRKALFSVLNYERARRPGLLGASVLGL

DDIHRAWRTFVLRVRAQDPPPEYFVKVDVTGAYDTIPQDRLTEVIASIIKPQNTYCVRRYAV

VQKAAHGVRKAFKSHVSTLTDLQPYMRQFVAHLQETSPLRDAVVIEQSSSLNEASGLFDVFL

RFMCHHAVRIRGKSYVQCQGI (SEQ ID NO:604)

pGEX-2TK with hTRT Nucleotides 1625 to 2458 of pGRN121

To produce large quantities of a fragment of hTRT protein, another *E. coli* expression vector pGEX-2TK construct was prepared.

This construct contains an insert derived from nucleotides 1625 to 2458 of the hTRT insert in the plasmid pGRN121. The vector directs expression in *E coli* of high levels of a fusion protein composed of glutathione-5-transferase, (underlined), thrombin cleavage sequence (double underlined), recognition sequence for heart muscle protein kinase (italicized) residues introduced by cloning in brackets ([GS-VTK]; SEQ ID NO:601) and hTRT protein fragment (in bold):

pGEX-2TK with hTRT Nucleotides 782 to 1636 of pGRN121

To produce large quantities of a fragment of hTRT protein, another *E. coli* expression vector pGEX-2TK construct was prepared.

This construct contains an insert derived from nucleotides 782 to 1636 of the hTRT insert in the plasmid pGRN121. The vector directs expression in *E coli* of high levels of a fusion protein composed of glutathione-S-transferase, (underlined), thrombin cleavage sequence (double underlined), recognition sequence for heart muscle protein kinase (italicized) residues introduced by cloning in brackets ([GS-VTK]; SEQ ID NO:601) and hTRT protein fragment (in bold):

MSPILGYWKIKGLVQPTRLLLEYLEEKYEEHLYERDEGDKWRNKKFELGLEFP

NLPYYIDGDVKLTQSMAIIRYIADKHNMLGGCPKERAEISMLEGAVLDIRYGVS

RIAYSKDFETLKVDFLSKLPEMLKMFEDRLCHKTYLNGDHVTHPDFMLYDALD

VVLYMDPMCLDAFPKLVCFKKRIEAIPQIDKYLKSSKYIAWPLQGWQATFGGG

DHPPKSDLVPRGS*RRASV*[GSVTK]ATSLEGALSGTRHSHPSVGRQHHAGPPSTSR

PPRPWDTPCPPVYAETKHFLYSSGDKEQLRPSFLLSSLRPSLTGARRLVETIFLGS

RPWMPGTPRRLPRLPQRYWQMRPLFLELLGNHAQCPYGVLLKTHCPLRAAVT

PAAGVCAREKPQGSVAAPEEEDTDPRRLVQLLRQHSSPWQVYGFVRACLRRLV

PPGLWGSRHNERRFLRNTKKFISLGKHAKLSLQELTWKMSVRDCAWLRRSPGV

GCVPAAEHRLREEILAKFLHWLMSVYVVELLRS (SEQ ID NO:605)

MSPILGYWKIKGLVQPTRLLLEYLEEKYEEHLYERDEGDKWRNKKFELGLEFPNLPYYIDGD

VKLTQSMAIIRYIADKHNMLGGCPKERAEISMLEGAVLDIRYGVSRIAYSKDFETLKVDFLS

KLPEMLKMFEDRLCHKTYLNGDHVTHPDFMLYDALDVVLYMDPMCLDAFPKLVCFKKRIEAI

PQIDKYLKSSKYIAWPLQGWQATFGGGDHPPKSDLVPRGS*RRASV*[GSVTK]MPRAPRCRAV

RSLLSHYREVLPLATFVRRLGPQGWRLVQRGDPAAFRALVAQCLVCVPWDARPPAAPSFRQV

SCLKELVARVLQRLCERGAKNVLAFGFALLDGARGGPPEATTSVRSYLPNTVTDALRGSGAW

GLLLRRVGDDVLVHLLARCALFVLVAPCAYQVCGPPLYQLGAATQARPPPHASGPRRRLGCE

RAWNHSVREAGVPLGLPAPGARRRGGSASRSLPLPKRPRRGAAPEPERTPVGQGSWAHPGRT

RGPSDRGFCVVSPARPAEEATSL (SEQ ID NO:606)

pT7FLhTRT with hTRT cDNA Lacking 5'-Non-Coding Sequence

As described above, in one embodiment, the invention provides for an hTRT that is modified in a site-specific manner to facilitate cloning into bacterial, mammalian, yeast and insect expression vectors without any 5' untranslated hTRT sequence. In some circumstances, minimizing the amount of non-protein encoding sequence allows for improved protein production (yield) and increased mRNA stability. In this embodiment of the invention, the hTRT gene's 5' non-coding region was removed before cloning into a bacterial expression vector.

This was effected by engineering an additional restriction endonuclease site just upstream (5') to the start (ATG) codon of the hTRT coding sequence (FIG. 16). The creation of a restriction site just 5' to the coding region of the protein allows for efficient production of a wide variety of vectors that encode fusion proteins, such as fusion proteins comprising labels and peptide TAGs, for immunodetection and purification.

Specifically, the oligonucleotide 5'-CCGGCCAC-CCCCATATGCCGCGCGCTCCC-3' (SEQ ID NO:607) was used as described above to modify hTRT cDNA nucleotides 779 to 781 of the hTRT cDNA (FIG. 16) from GCG to CAT. These 3 nucleotides are the last nucleotides before the ATG start codon so they do not modify the protein sequence. The change in sequence results in the creation of a unique NdeI restriction site in the hTRT cDNA. Single-stranded hTRT DNA was used as a DNA source for the site directed mutagenesis. The resulting plasmid was sequenced to confirm the success of the mutagenesis.

This modification allowed the construction of the following plasmid of the invention, designated pT7FLhTRT. The site-specifically modified hTRT sequence (addition of the NdeI restriction site) was digested with NdeI and NotI (and filled in with Klenow enzyme to generate blunt ended DNA) to generate an hTRT encoding nucleic acid fragment. The fragment was then cloned into a pSL3418 plasmid previously restriction digested with NdeI and SmaI (also a blunt ended cutter). pSL 3418 is a modified pAED4 plasmid into which a FLAG sequence (Immunex Corp, Seattle Wash.) and an enterokinase sequence are inserted just upstream from the above-referenced NdeI site. This plasmid, designated pT7FLhTR, allows the expression of full length hTRT (with a Flag-Tag at its 5' end) in an *E. coli* strain expressing the T7 RNA polymerase.

Plasmids with hTRT cDNA Lacking 3'-Non-Coding Sequence

As discussed above, the invention provides for expression vectors containing TRT-encoding nucleic acids in which some or all non-coding sequences have been deleted. In some circumstances, minimizing the amount of non-protein encoding sequence allows for improved protein production (yield) and increases mRNA stability. In this embodiment of the invention, the 3' untranslated region of hTRT is deleted before cloning into a bacterial expression plasmid.

The plasmid pGRN121, containing the full length hTRT cDNA, as discussed above, was first deleted of all Apa1 sites. This was followed by deletion of the MscI-HincII hTRT restriction digest enzyme fragment containing the 3'UTR. The NcoI-XbaI restriction digest fragment containing the stop codon of hTRT was then inserted into the NcoI-XbaI site of pGRN121 to make a plasmid equivalent to pGRN121, designated pGRN124, except lacking the 3'UTR.

Bacterial Expression Vectors Using Antibiotic Selection Markers

The invention also provides for bacterial expression vectors that can contain selection markers to confer a selectable phenotype on transformed cells and sequences coding for episomal maintenance and replication such that integration into the host genome is not required. For example, the marker may encode antibiotic resistance, particularly resistance to chloramphenicol (see Harrod (1997) *Nucleic Acids Res.* 25: 1720-1726), kanamycin, G418, bleomycin and hygromycin, to permit selection of those cells transformed with the desired DNA sequences, see for example, Blondelet-Rouault (1997) Gene 190:315-317- and Mahan (1995) *Proc Natl Acad Sci USA* 92:669-673.

In one embodiment of the invention, the full length hTRT was cloned into a modified BlueScript plasmid vector (Stratagene, San Diego, Calif.), designated pBBS235, into which a chloramphenicol antibiotic resistence gene had been inserted. The NotI fragment from pGRN124 (discussed above) containing the hTRT ORF into the NotI site of pBBS235 so that the TRT ORF is in the opposite orientation of the vector's Lac promoter. This makes a plasmid that is suitable for mutageneis of plasmid inserts, such as TRT nucleic acids of the invention. This plasmid construct, designated pGRN125, can be used in the methods of the invention involving mutagenesis of telomerase enzyme and TRT protein coding sequences and for in vitro transcription of hTRT using the T7 promoter (and in vitro transcription of antisense hTRT using the T3 promoter).

In another embodiment of the invention, NotI restriction digest fragments from pGRN124 containing the hTRT ORF were subcloned into the NotI site of pBBS235 (described above) so the TRT ORF is in the same orientation as the vector's Lac promoter. This makes a plasmid, designated pGRN126, that can be used for expression of full length hTRT in *E. coli*. The expressed product will contain 29 amino acids encoded by the vector pBBS235, followed by 18 amino acids encoded by the 5'UTR of hTRT, followed by the full length hTRT protein.

In a further embodiment of the invention, in vitro mutagenesis of pGRN125 was done to convert the hTRT initiating ATG codon into a Kozak consensus and create EcoRI and BglII restriction digest sites to facilitate cloning into expression vectors. The oligonucleotide 5'-TGCG-CACGTGGGAAGCCCTGGCagatctgAattCcaCcATGCC GCGCGCTCCCCGCTG-3' (SEQ ID NO:608) (altered nucleotides in lower case) was used in the mutagenesis procedure. The resulting expression vector was designated pGRN127.

In another embodiment of the invention, the second Asp of the TRT "DD motif" was converted to an alanine to create a non-functional telomerse enzyme, thus creating a mutant TRT protein for use as a dominant/negative mutant. The hTRT coding sequence was mutagenized in vitro using the oligonucleotide 5'-CGGGACGGGCTGCTCCT-GCGTTTGGTGGAcGcgTTCTTGTTGGT-GACACCTCACCT CACC-3' (SEQ ID NO:609) to convert the asparagine codon for residue 869 (Asp869) to an alanine (Ala) codon. This also created an MluI restriction enzyme site. The resulting expression plasmid was designated pGRN130, which also contains the Kozak consensus sequence as described for pGRN127.

The invention also provides a vector designed to express an antisense sequence fragment of hTRT. The pGRN126 plasmid was cut to completion with MscI and SmaI restriction enzymes and religated to delete over 95% of the hTRT ORF. One SmaI-MscI fragment was re-inserted during the process to recreate CAT activity. This unpurified plasmid was then redigested with SalI and EcoRI and the fragment containing the initiating codon of the hTRT ORF was inserted into the SalI-EcoRI sites of pBBS212 to make an antisense expression plasmid expressing the antisense sequence spanning the 5'UTR and 73 bases pair residues of the hTRT ORF (in mammalian cells). This plasmid was designated pGRN135.

Expression of hTRT Telomerase in Yeast

The present invention also provides hTRT-expressing yeast expression vectors to produce large quantities of full-length, biologically active hTRT.

*Pichia pastoris* Expression Vector pPICZ B and Full Length hTRT

To produce large quantities of full-length, biologically active hTRT, the *Picha pastoris* expression vector pPICZ B (Invitrogen, San Diego, Calif.) was selected. The hTRT-coding sequence insert was derived from nucleotides 659 to 4801 of the hTRT insert in plasmid pGRN121. This nucleotide sequence includes the full-length sequence encoding hTRT. This expression vector is designed for inducible expression in *P. pastoris* of high levels of full-length, unmodified hTRT protein. Expression is driven by a yeast promoter, but the expressed sequence utilizes the hTRT initiation and termination codons. No exogenous codons were introduced by the cloning. The resulting pPICZ B/hTRT vector was used to transform the yeast.

*Pichia pastoris* Expression Vector hTRT-His6/pPICZ B

A second Picha pastoris expression vector of the invention derived from pPICZ B, also contains the full-length sequence encoding hTRT derived from nucleotides 659 to 4801 of the hTRT insert in the plasmid pGRN121. This hTRT-His6/pPICZ B expression vector encodes full length hTRT protein fused at its C-terminus to the Myc epitope and His6 reporter tag sequences. The hTRT stop codon has been removed and replaced by vector sequences encoding the Myc epitope and the His6 reporter tag as well as a stop codon. This vector is designed to direct high-level inducible expression in yeast of the following fusion protein, which consists of hTRT sequence (underlined), vector sequences in brackets ([L] and [NSAVD]; SEQ ID NO:610) the Myc epitope (double underlined), and the His6 tag (italicized):

MPRAPRCRAVRSLLRSHYREVLPLATFVRRLGPQGWRLVQRGDPAAFRALVAQCLV

CVPWDARPPPAAPSFRQVSCLKELVARVLQRLCERGAKNVLAFGFALLDGARGGPP

EAFTTSVRSYLPNTVTDALRGSGAWGLLLRRVGDDVLVHLLARCALFVLVAPSCAY

QVCGPPLYQLGAATQARPPPHASGPRRRLGCERAWNHSVREAGVPLGLPAPGARRR

GGSASRSLPLPKRPRRGAAPEPERTPVGQGSWAHPGRTRGPSDRGFCVVSPARPAEE

ATSLEGALSGTRHSHPSVGRQHHAGPPSTSRPPRPWDTPCPPVYAETKHFLYSSGDKE

QLRPSFLLSSLRPSLTGARRLVETIFLGSRPWMPGTPRRLPRLPQRYWQMRPLFLELLG

NHAQCPYGVLLKTHCPLRAAVTPAAGVCAREKPQGSVAAPEEEDTDPRRLVQLLRQ

HSSPWQVYGFVRACLRRLVPPGLWGSRHNERRFLRNTKKFISLGKHAKLSLQELTW

KMSVRDCAWLRRSPGVGCVPAAEHRLREEILAKFLHWLMSVYVVELLRSFFYVTET

TFQKNRLFFYRKSVWSKLQSIGIRQHLKRVQLRELSEAEVRQHREARPALLTSRLRFIP

KPDGLRPIVNMDYVVGARTFRREKRAERLTSRVKALFSVLNYERARRPGLLGASVLG

LDDIHRAWRTFVLRVRAQDPPPELYFVKVDVTGAYDTIPQDRLTEVIASIIKPQNTYC

VRRYAVVQKAAHGHVRKAFKSHVSTLTDLQPYMRQFVAHLQETSPLRDAVVIEQSS

SLNEASSGLFDVFLRFMCHHAVRIRGKSYVQCQGIPQGSILSTLLCSLCYGDMENKLF

AGIRRDGLLLRLVDDFLLVTPHLTHAKTFLRTLVRGVPEYGCVVNLRKTVVNFPVED

EALGGTAFVQMPAHGLFPWCGLLLDTRTLEVQSDYSSYARTSIRASLTFNRGFKAGR

NMRRKLFGVLRLKCHSLFLDLQVNSLQTVCTNIYKILLLQAYRFHACVLQLPFHQQV

WKNPTFFLRVISDTASLCYSILKAKNAGMSLGAKGAAGPLPSEAVQWLCHQAFLLKL

TRHRVTYVPLLGSLRTAQTQLSRKLPGTTLTALEAAANPALPSDFKTILD[L]EQKLISE

EDL[NSAVD]*HHHHHH* (SEQ ID NO:611)

Expression of hTRT in Insect Cells

The present invention also provides hTRT telomerase-expressing insect cell expression vectors that produce large quantities of full-length, biologically active hTRT.

Baculovirus Expression Vector pVL1393 and Full Length hTRT

The telomerase coding sequence of interest was cloned into the baculovirus expression vector pVL1393 (Invitrogen, San Diego, Calif.). This construct was subsequently cotransfected into *Spodoptera fungupeida* (sf-9) cells with linearized DNA from Autograph california nuclear polyhedrosis virus (Baculogold-AcMNPV). The recombinant baculoviruses obtained were subsequently plaque purified and expanded following standard protocols.

This expression vector provider, for expression in insect cells of high levels of full-length hTRT protein. Expression is driven by a baculoviral polyhedrin gene promoter. No exogenous codons were introduced by the cloning.

Baculovirus Expression Vector pBlueBacHis2 B and Full Length hTRT

To produce large quantities of full-length, biologically active hTRT, the baculovirus expression vector pBlueBacHis2 B (Invitrogen, San Diego, Calif.) was selected as a source of control elements. The hTRT-coding insert consisted of nucleotides 707 to 4776 of the hTRT insert in plasmid pGRN121.

A full length hTRT with a His6 and Anti-Xpress tags (Invitrogen) was also constructed. This vector also contains an insert consisting of nucleotides 707 to 4776 of the hTRT insert from the plasmid pGRN121. The vector directs expression in insect cells of high levels of full length hTRT protein fused to a cleavable 6-histidine and Anti-Xpress tags, and the amino acid sequence of the fusion protein is shown below; (-*-) denotes enterokinase cleavage site:

Baculovirus Expression Vector pBlueBac4.5 and Full Length hTRT Protein

To produce large quantities of full-length, biologically active hTRT, a second baculovirus expression vector, pBlueBac4.5 (Invitrogen, San Diego, Calif.) was constructed. The hTRT-coding insert also consisted of nucleotides 707 to 4776 of the hTRT from the plasmid pGRN121.

Baculovirus Expression Vector pMelBacB and Full Length hTRT Protein

To produce large quantities of full-length, biologically active hTRT, a third baculovirus expression vector, pMelBacB (Invitrogen, San Diego, Calif.) was constructed. The hTRT-coding insert also consists of nucleotides 707 to 4776 of the hTRT insert from the plasmid pGRN121.

pMelBacB directs expression of full length hTRT in insect cells to the extracellular medium through the secretory pathway using the melittin signal sequence. High levels of full length hTRT are thus secreted. The melittin signal sequence is cleaved upon excretion, but is part of the protein pool that remains intracellularly. For that reason, it is indicated in parentheses in the following sequence. The sequence of the fusion protein encoded by the vector is shown below:

```
MPRGSHHHHHHGMASMTGGQQMGRDLYDDDDL-*-DPSSRSAAGTMEFAAA

STQRCVLLRTWEALAPATPAMPRAPRCRAVRSLLRSHYREVLPLATFVRRLGPQGW

RLVQRGDPAAFRALVAQCLVCVPWDARPPPAAPSFRQVSCLKELVARVLQRLCERG

AKNVLAFGFALLDGARGGPPEAFTTSVRSYLPNTVTDALRGSGAWGLLLRRVGDDV

LVHLLARCALFVLVAPSCAYQVCGPPLYQLGAATQARPPPHASGPRRRLGCERAWN

HSVREAGVPLGLPAPGARRRGGSASRSLPLPKRPRRGAAPEPERTPVGQGSWAHPGR

TRGPSDRGFCVVSPARPAEEATSLEGALSGTRHSHPSVGRQHHAGPPSTSRPPRPWDT

PCPPVYAETKHFLYSSGDKEQLRPSFLLSSLRPSLTGARRLVETIFLGSRPWMPGTPRR

LPRLPQRYWQMRPLFLELLGNHAQCPYGVLLKTHCPLRAAVTPAAGVCAREKPQGS

VAAPEEEDTDPRRLVQLLRQHSSPWQVYGFVRACLRRLVPPGLWGSRHNERRFLRN

TKKFISLGKHAKLSLQELTWKMSVRDCAWLRRSPGVGCVPAAEHRLREEILAKFLH

WLMSVYVVELLRSFFYVTETTFQKNRLFFYRKSVWSKLQSIGIRQHLKRVQLRELSE

AEVRQHREARPALLTSRLRFIPKPDGLRPIVNMDYVVGARTFRREKRAERLTSRVKA

LFSVLNYERARRPGLLGASVLGLDDIHRAWRTFVLRVRAQDPPPELYFVKVDVTGA

YDTIPQDRLTEVIASIIKPQNTYCVRRYAVVQKAAHGHVRKAFKSHVSTLTDLQPYM

RQFVAHLQETSPLRDAVVIEQSSSLNEASSGLFDVFLRFMCHHAVRIRGKSYVQCQGI

PQGSILSTLLCSLCYGDMENKLFAGIRRDGLLLRLVDDFLLVTPHLTHAKTFLRTLVR

GVPEYGCVVNLRKTVVNFPVEDEALGGTAFVQMPAHGLFPWCGLLLDTRTLEVQSD

YSSYARTSIRASLTFNRGFKAGRNMRRKLFGVLRLKCHSLFLDLQVNSLQTVCTNIY

KILLLQAYRFHACVLQLPFHQQVWKNPTFFLRVISDTASLCYSILKAKNAGMSLGAK

GAAGPLPSEAVQWLCHQAFLLKLTRHRVTYVPLLGSLRTAQTQLSRKLPGTTLTALE

AAANPALPSDFKTILD (SEQ ID NO:612)
```

```
(MKFLVNVALVFMVVYISYIYA)-*-DPSSRSAAGTMEFAAASTQRCVLLRTWE
ALAPATPAMPRAPRCRAVRSLLRSHYREVLPLATFVRRLGPQGWRLVQRGDPAAFR
ALVAQCLVCVPWDARPPPAAPSFRQVSCLKELVARVLQRLCERGAKNVLAFGFALL
DGARGGPPEAFTTSVRSYLPNTVTDALRGSGAWGLLLRRVGDDVLVHLLARCALFV
LVAPSCAYQVCGPPLYQLGAATQARPPPHASGPRRRLGCERAWNHSVREAGVPLGL
PAPGARRRGGSASRSLPLPKRPRRGAAPEPERTPVGQGSWAHPGRTRGPSDRGFCVV
SPARPAEEATSLEGALSGTRHSHPSVGRQHHAGPPSTSRPPRPWDTPCPPVYAETKHF
LYSSGDKEQLRPSFLLSSLRPSLTGARRLVETIFLGSRPWMPGTPRRLPRLPQRYWQM
RPLFLELLGNHAQCPYGVLLKTHCPLRAAVTPAAGPVAREKPQGSVAAPEEEDTDPR
RLVQLLRHSSPWQVYGFVRACLRRLVPPGLWGSRHNERRFLRNTKKFISLGKHAKL
SLQELTWKMSVRDCAWLRRSPGVGCVPAAEHRLREEILAKFLHWLMSVYVVELLRS
FFYVTETTFQKNRLFFYRKSVWSKLQSIGIRQHLKRVQLRELSEAEVRQHREARPALL
TSRLRFIPKPDGLRPIVNMDYVVGARTFRREKRAERLTSRVKALFSVLNYERARRPGL
LGASVLGLDDIHRAWRTFVLRVRAQDPPPELYFVKVDVTGAYDTIPQDRLTEVIASII
KPQNTYCVRRYAVVQKAAHGHVRKAFKSHVSTLTDLQPYMRQFVAHLQETSPLRD
AVVIEQSSSLNEASSGLFDVFLRFMCHHAVRIRGKSYVQCQGIPQGSILSTLLCSLCYG
DMENKLFAGIRRDGLLLRLVDDFLLVTPHLTHAKTFLRTLFRGVPEYGCVVNLRKTV
VNFPVEDEALGGTAFVQMPAHGLFPWCGLLLDTRTLEVQSDYSSYARTSIRASLTFN
RGFKAGRNMRRKLFGVLRLKCHSLFLDLQVNSLQTVCTNIYKILLLQAYRFHACVLQ
LPFHQQVWKNPTFFLRVISDTASLCYSILKAKNAGMSLGAKGAAGPLPSEAVQWLCH
QAFLLKLTRHRVTYVPLLGSLRTAQTQLSRKLPGTTLTALEAAANPALPSDFKTILD
(SEQ ID NO:613)
```

Expression of hTRT in Mammalian Cells

The present invention also provides vectors to produce hTRT in large quantities as full-length, biologically active protein in a variety of mammalian cell lines, which is useful in many embodiments of the invention, as discussed above.

MPSV-hTRT Expression Plasmids

The invention also provides for an expression system for use in mammalian cells that gives the highest possible expression of recombinant protein, such as telomerase, without actually modifying the coding sequence (e.g. optimizing codon usage). In one embodiment, the invention provides MPSV mammalian expression plasmids (from plasmid pBBS212, described as pMPSV-TM in Lin J-H (1994) *Gene* 47:287-292) capable of expressing the TRTs of the invention. The MPSV plasmids can be expressed either as stable or transient clones.

In this expression system, while the hTRT coding sequence itself is unchanged, exogenous transcriptional control elements are incorporated into the vector. The myeloproliferative sarcoma virus (MPSV) LTR (MPSV-LTR) promoter, enhanced by the cytomegalovirus (CMV) enhancer, is incorporated for transcriptional initiation. This promoter consistently shows higher expression levels in cell lines (see Lin J-H (1994) supra). A Kozak consensus sequence can be incorporated for translation initiation (see Kozak (1996) *Mamm. Genome* 7:563-574). All extraneous 5' and 3' untranslated hTRT sequences can be removed to insure that these sequences do not interfere with expression, as discussed above. The MPSV plasmid containing the complete hTRT coding sequence, with all extraneous sequences included, is designated pGRN133. A control, hTRT "antisense" plasmid was also constructed. This vector is identical to pGRN133 except that the TRT insert is the antisense sequence of hTRT (the antisense, which control can be used as a vector is designated pGRN134). The MPSV plasmid containing the complete hTRT coding sequence with all other extraneous sequences removed and containing the Kozak consensus sequence is designated pGRN145.

Two selection markers, PAC (Puromycin-N-acetyl-transferase=Puromycin resistance) and HygB (Hygromycin B=Hygromycin resistance) are present for selection of the plasmids after transfection (see discussion referring to selectable markers, above). Double selection using markers on both sides of the vector polylinker should increase the stability of the hTRT coding sequence. A DHFR (dihydrofolate reductase) encoding sequence is included to allow amplification of the expression cassette after stable clones are made. Other means of gene amplification can also be used to increase recombinant protein yields.

The invention also provides for MPSV mammalian expression plasmids containing hTRT fusion proteins. In one embodiment, the hTRT sequence, while retaining its 5' untranslated region, is linked to an epitope flag, such as the IBI FLAG (International Biotechnologies Inc. (IBI), Kodak, New Haven, Conn.) and inserted into the MPSV expression plasmid (designated pGRN147). This particular construct contains a Kozak translation initiation site. The expressed fusion protein can be purified using the M–1 anti-FLAG octapeptide monoclonal antibody (IBI, Kodak, supra).

In another embodiment, hTRT is site-specifically altered. One amino acid residue codon is mutagenized, changing the aspartic acid at position 869 to an alanine. This Asp869→Ala hTRT mutant, retaining its 5' untranslated region and incorporating a Kozak sequence, was inserted into an MPSV expression plasmid, and designated pGRN146. The Asp869→>Ala hTRT mutant was further engineered to contain the FLAG sequence, as described above, and the insert cloned into an MPSV expression plasmid. One such expression plasmid is designated pGRN154-I. Specifically, for pGRN154-I, an Eam1105I restriction digest fragment from pGRN146 containing the Kozak sequence-containing "front end" (5' segment) of hTRT is cloned into the Eam1105I sites of pGRN147 (see above) to make an MPSV expression plasmid capable of expressing hTRT with a Kozak sequence, the above-described D869→A mutation, and the IBI flag.

Another embodiment of the invention is an expression plasmid derived from pGRN146. The mammalian expression plasmid, designated pGRN152, was generated by excising the EcoRI fragment from plasmid pGRN146 (containing the hTRT ORF) and cloned into the EcoRI site of pBBS212 to remove the 5'UTR of hTRT. The hTRT is oriented so that its expression is controlled by the MPSV promoter. This makes a mammalian expression plasmid that expresses hTRT with a Kozak consensus sequence and the D869→A mutation, and uses the MPSV promoter.

The invention provides for a mammalian expression vector in which hTRT is oriented so that the hTRT coding sequence is driven by the MPSV promoter. For example, an EcoR1 restriction digest fragment from pGRN137 containing the hTRT open reading frame (ORF) was cloned into the EcoR1 site of pBBS212 (see below), thus removing the 5' untranslated region (5'-UTR) of hTRT. pGRN137 was constructed by excising a SalI-Sse83871 fragment from pGRN130, described below, containing the Kozak mutation of hTRT into the Sal 1-SSE 8387I sites of pGRN136, making a mammalian expression plasmid expressing hTRT containing a Kozak consensus sequence off the MPSV promoter. Plasmid pGRN136 was constructed by excising a HindIII SalI fragment from pGRN126 containing the hTRT ORF and cloning it into the HindIII SalI sites of plasmid, pBBS242, making a mammalian expression plasmid expressing hTRT off the MPSV promoter). This makes a mammalian expression plasmid, designated pGRN145, that expresses hTRT with a Kozak consensus sequence using the MPSV promoter. See also the pGRN152 MPSV promoter-driven mammalian expression vector described below.

hTRT Expressed in 293 Cells using Episomal Vector pEBVHis

An episomal vector, pEBVHis (Invitrogen, San Diego, Calif.) was engineered to express an hTRT fusion protein comprising hTRT fused to an N-terminal extension epitope tag, the Xpress epitope (Invitrogen, San Diego, Calif.) (designated pGRN122). The NotI hTRT fragment from pGRN121 containing the hTRT ORF was cloned into the NotI site of pEBVHisA so that the hTRT ORF is in the same orientation as the vector's Rous Sarcoma Virus (RSV) promoter. In this orientation the His6 flag was relatively closer to the N-terminus of hTRT.

A vector was also constructed containing as an insert the antisense sequence of hTRT and the epitope tag (the plasmid designated pGRN123, which can be used as a control). The vector was transfected into 293 cells and translated hTRT identified and isolated using an antibody specific for the Xpress epitope. pEBVHis is a hygromycin resistant EBV episomal vector that expresses the protein of interest fused to a N-terminal peptide. Cells carrying the vector are selected and expanded, then nuclear and cytoplasmic extracts prepared. These and control extracts are immunoprecipitated with anti-Xpress antibody, and the immunoprecipitated beads are tested for telomerase activity by conventional assay.

Expression of Recombinant hTRT in Mortal, Normal Diploid Human Cells

In one embodiment of the invention, recombinant hTRT and necessary telomerase enzyme complex components can be expressed in normal, diploid mortal cells to increase their proliferative capacity or to immortalize them, or to facilitate immortalizing them. This allows one to obtain diploid immortal cells with an otherwise normal phenotype and karotype. As discussed above, this use of telomerase has enormous commercial utility.

Sense hTRT (FIG. 16) and antisense hTRT were cloned into a CMV vector. These vectors were purified and transiently transfected into two normal, mortal, diploid human cell clones. The human clones were young passage diploid human BJ and IMR90 cell strains.

Analysis of telomerase activity using a TRAP assay utilizing the TRAPeze™ Kit (Oncor, Inc., Gaithersburg, Md.) showed that transfection of sense hTRT—but not antisense hTRT—generated telomerase activity in both the BJ and IMR90 cell strains.

Expression of Recombinant hTRT in Immoralized IMR90 Human Cells

Using the same hTRT sense construct cloned into CMV vectors used in the above described diploid human BJ and IMR90 cell strains studies, immortalized SW13 ALT pathway cell line (an IMR90 cell immortalized with SV40 antigen) was transiently transfected. A TRAP assay (TRAPeze, Oncor, Inc, Gaithersburg, Md.) demonstrated that telomerase activity was generated in the sense construct transfected cells.

Vectors for Regulated Expression of hTRT in Mammalian Cells: Inducible and Repressible Expression of hTRT The invention provides vectors that can be manipulated to induce or repress the expression of the TRTs of the invention, such as hTRT. For example, the hTRT coding sequence can be cloned into the Ecdysone-Inducible Expression System from Invitrogen (San Diego, Calif.) and the Tet-On and Tet-off tetracycline regulated systems from Clontech Laboratories, Inc. (Palo Alto, Calif.). Such inducible expression systems are provided for use in the methods of the invention where it is important to control the level or rate of transcription of transfected TRT. For example, the invention provides for cell lines immortalized through the expression of hTRT; such cells can be rendered "mortal" by inhibition of hTRT expression by the vector through transcriptional controls, such as those provided by the Tet-Off system. The invention also provides for methods of expressing TRT only transiently to avoid the constitutive expression of hTRT, which may lead to unwanted "immortalization" of the transfected cells, as discussed above.

The Ecdysone-Inducible Mammalian Expression System is designed to allow regulated expression of the gene of interest in mammalian cells. The system is distinguished by its tightly regulated mechanism that allows almost no detectable basal expression and greater than 200-fold inducibility in mammalian cells. The expression system is based on the heterodimeric ecdysone receptor of *Drosophila*. The Ecdysone-Inducible Expression System uses a steroid hormone ecdysone analog, muristerone A, to activate expression of hTRT via a heterodimeric nuclear receptor. Expression levels have been reported to exceed 200-fold over basal levels with no effect on mammalian cell physiology "Ecdysone-Inducible Gene Expression in Mammalian Cells and Transgenic Mice" (1996) *Proc. Natl. Acad. Sci. USA* 93, 3346-3351). Once the receptor binds ecdysone or muristerone, an analog of ecdysone, the receptor activates an ecdysone-responsive promoter to give controlled expression of the gene of interest. In the Ecdysone-Inducible Mammalian Expression System, both monomers of the =heterodimeric receptor are constitutively expressed from the same vector, pVgRXR. The ecdysone-responsive promoter, which ultimately drives expression of the gene of interest, is located on a second vector, pIND, which drives the transcription of the gene of interest.

The hTRT coding sequence is cloned in the pIND vector (Clontech Laboratories, Inc, Palo Alto, Calif.), which contains 5 modified ecdysone response elements (E/GREs) upstream of a minimal heat shock promoter and the multiple cloning site. The construct is then transfected in cell lines which have been pre-engineered to stably express the ecdysone receptor. After transfection, cells are treated with muristerone A to induce intracellular expression from pIND.

The Tet-on and Tet-off expression systems (Clontech, Palo Alto, Calif.) give access to the regulated, high-level gene expression systems described by Gossen (1992) "Tight control of gene expression in mammalian cells by tetracycline responsive promoters" *Proc. Natl. Acad. Sci. USA* 89:5547-5551, for the Tet-Off transcription repression system; and Gossen (1995) "Transcriptional activation by tetracycline in mammalian cells" Science 268:1766-1769, for the Tet-On inducible transcriptional system. In "Tet-Off" transformed cell lines, gene expression is turned on when tetracycline (Tc) or doxycycline ("Dox;" a Tc derivative) is removed from the culture medium. In contrast, expression is turned on in Tet-On cell lines by the addition of Tc or Dox to the medium. Both systems permit expression of cloned genes to be regulated closely in response to varying concentrations of Tc or Dox.

This system uses the "pTRE" as a response plasmid that can be used to express a gene of interest. Plasmid pTRE contains a multiple cloning site (MCS) immediately downstream of the Tet-responsive PhCMV*-1 promoter. Genes or cDNAs of interest inserted into one of the sites in the MCS will be responsive to the tTA and rtTA regulatory proteins in the Tet-Off and Tet-On systems, respectively. PhCMV*-1 contains the Tet-responsive element (TRE), which consists of seven copies of the 42-bp tet operator sequence (tetO). The TRE element is just upstream of the minimal CMV promoter (PminCMV), which lacks the enhancer that is part of the complete CMV promoter in the pTet plasmids. Consequently, PhCMV*-1 is silent in the absence of binding of regulatory proteins to the tetO sequences. The cloned insert must have an initiation codon. In some cases, addition of a Kozak consensus ribosome binding site may improve expression levels; however, many cDNAs have been efficiently expressed in Tet systems without the addition of a Kozak sequence. pTRE-Gene X plasmids are cotransfected with pTK-Hyg to permit selection of stable transfectants.

Setting up a Tet-Off or Tet-On expression system generally requires two consecutive stable transfections to create a "double-stable" cell line that contains integrated copies of genes encoding the appropriate regulatory protein and TRT under the control of a TRE. In the first transfection, the appropriate regulatory protein is introduced into the cell line of choice by transfection of a "regulator plasmid" such as pTet-Off or pTet-On vector, which expresses the appropriate regulatory proteins. The hTRT cloned in the pTRE "response plasmid" is then introduced in the second transfection to create the double-stable Tet-Off or Tet-On cell line. Both systems give very tight on/off control of gene expression, regulated dose-dependent induction, and high absolute levels of gene expression.

Expression Recombinant hTRT With DHFR and Adenovirus Sequences

The pGRN155 plasmid construct was designed for transient expression of hTRT cDNA in mammalian cells. A Kozak consensus is inserted at the 5' end of the hTRT sequence. The hTRT insert contains no 3' or 5' UTR. The hTRT cDNA is inserted into the EcoRI site of p91023(B) (Wong (1985) *Science* 228:810-815). The hTRT insert is in the same orientation as the DHFR ORF.

Plasmid pGRN155 contains the SV40 origin and enhancer just upstream of an adenovirus promoter, a tetracycline resistance gene, an *E. coli* origin and an adenovirus VAI and VAII gene region. This expression cassette contains, in the following order: the adenovirus major late promoter; the adenovirus tripartite leader; a hybrid intron consisting of a 5' splice site from the first exon of the tripartite leader and a 3' splice site from the mouse immunoglobulin gene; the hTRT cDNA; the mouse DHFR coding sequence; and, the SV40 polyadenylation signal.

The adenovirus tripartite leader and the VA RNAs have been reported to increase the efficiency with which polycistronic mRNAs are translated. DHFR sequences have been reported to enhance the stability of hybrid mRNA. DHFR sequences also can provide a marker for selection and amplification of vector sequences. See Logan (1984) *Proc. Natl. Acad. Sci. USA* 81:3655); Kaufman (1985) Proc. Natl. Acad. Sci. USA 82: 689 and Kaufman (1988) Focus (Life Technologies, Inc.), Vol. 10, no. 3). This makes the expression vector particularly useful for transient expression.

Other expression plamids of the invention are described for illustrative purposes.

pGRN121

The EcoRI fragment from lambda clone 25-1.1.6 containing the entire cDNA encoding hTRT protein was inserted into the EcoRI site of pBluescriptIISK+ such that the 5' end of the cDNA is near the T7 promoter in the vector. The selectable marker that is used with this vector is ampicillin.

pGRN122

The NotI fragment from pGRN121 containing the hTRT ORF was inserted into the NotI site of pEBVHisA so that the coding sequence is operably linked to the RSV promoter. This plasmid expresses a fusion protein composed of a His6 flag fused to the N-terminal of the hTRT protein. The selectable marker that is used with this vector is ampicillin or hygromycin.

pGRN123

The NotI fragment from pGRN121 containing the hTRT ORF was inserted into the NotI site of pEBVHisA so that the coding sequence is in the opposite orientation as the RSV promoter, thus expressing antisense hTRT.

pGRN124

Plasmid pGRN121 was deleted of all ApaI sites followed by deletion of the MscI-HincII fragment containing the 3'UTR. The Nco-XbaI fragment containing the stop codon of the hTRT coding sequence was then inserted into the Nco-XbaI sites of pGRN121 to make a plasmid equivalent to pGRN121 except lacking the 3'UTR, which may be preferred for increased expression levels in some cells.

pGRN125

The NotI fragment from pGRN124 containing the hTRT coding sequence was inserted into the NotI site of pBBS235 so that the open reading frame is in the opposite orientation of the Lac promoter. The selectable marker that is used with this vector is chloramphenicol.

pGRN126

The NotI fragment from pGRN124 containing the hTRT coding sequence was inserted into the NotI site of pBBS235 so that the hTRT coding sequence inserted is in the same orientation as the Lac promoter.

pGRN127

The oligonucleotide 5'-TGCGCACGTGGGAAGC-CCTGGCagatctgAattCcaCcATGC CGCGCGCTC-CCCGCTG-3' (SEQ ID NO:608) was used in in vitro mutagenesis of pGRN 125 to convert the initiating ATG codon of the hTRT coding sequence into a Kozak consensus sequence and create EcoRI and BglII sites for cloning. Also, oligonucleotide COD2866 was used to convert AmpS to AmpR (ampicillin resistant) and oligonucleotide COD1941 was used to convert CatR (chloramphenicol resistant) to CatS (chloramphenicol sensitive).

pGRN128

The oligonucleotide 5'-TGCGCACGTGGGAAGC-CCTGGCagatctgAattCcaCcATG CCGCGCGCTC-CCCGCTG-3' (SEQ ID NO:608) is used in in vitro mutagenesis to convert the initiating ATG codon of hTRT into a Kozak consensus and create EcoRI and BglII sites for cloning. Also, oligo 5'-CTGCCCTCAGACTTCAAGAC-CATCCTGGACTACAA GGACGACGATGACAAAT-GAATTCAGATCTGCGGCCGCCACCGCG-GTGGAGCTCC AGC-3' (SEQ ID NO:614) is used to insert the IBI Flag (International Biotechnologies Inc. (IBI), Kodak, New Haven, Conn.) at the C-terminus and create EcoRI and BglII sites for cloning. Also, COD2866 is used to convert AmpS to AmpR and COD1941 is used to convert CatR to CatS.

pGRN129

The oligonucleotide 5'-CGGGACGGGCTGCTCCT-GCGTTTGGTGGAcGcgTTCTTGTTGGT-GACACCTCACCT CACC-3' (SEQ ED NO:609) was used by in vitro mutagenesis to convert Asp869 to an Ala codon (i.e. the second Asp of the DD motif was converted to an Alanine to create a dominant/negative hTRT mutant). This also created a MluI site. Also, oligonucleotide 5'-CTGC-CCTCAGACTTCAAGACCATCCTGGACTACAAGG ACGACGATGACAAATGAATTCAGATCT-GCGGCCGCCACCGCGGTGGAGCTCCAG C-3' SEQ ID NO:614) was used to insert the IBI Flag at the C-terminus and create EcoRI and BglII sites for cloning. Also, COD2866 was used to convert AmpS to AmpR and COD1941 was used to convert CatR to CatS.

pGRN130

The oligonucleotide 5'-CGGGACGGGCTGCTCCT-GCGTTTGGTGGAcGcgTTCTT GTTGGTGACACCT-CACCTCACC-3' (SEQ ID NO:609) was used in in vitro mutagenesis to convert the Asp869 codon into an Ala codon (i.e. the second Asp of the DD motif was converted to an Alanine to make a dominant/negative variant protein). This also created an MluI site. Also, the oligonucleotide 5'-TGCGCACGTGGGAAGCCCTGGCagatctgAatt CcaC-cATGCCGCGCGCTCCCCGCTG-3' (SEQ ID NO:608) was used in in vitro mutagenesis to convert the initiating ATG codon of the hTRT coding sequence into a Kozak consensus sequence and create EcoRI and BglII sites for cloning. Also, COD2866 was used to convert AmpS to AmpR and COD1941 was used to convert CatR.

pGRN131

The EcoRI fragment from pGRN128 containing the hTRT ORF with Kozak sequence and IBI Flag mutations is inserted into the EcoRI site of pBBS212 so that the hTRT ORF is expressed off the MPSV promoter. Plasmid pBSS212 contains a MPSV promoter, the CMV enhancer, and the SV40 polyadenylation site.

pGRN132

The EcoRI fragment from pGRN128 containing the hTRT ORF with Kozak sequence and IBI Flag mutations is inserted into the EcoRI site of pBBS212 so that the antisense of the hTRT ORF is expressed off the MPSV promoter.

pGRN133

The EcoRI fragment from pGRN121 containing the hTRT coding sequence was inserted into the EcoRI site of pBBS212 so that the hTRT protein is expressed under the control of the MPSV promoter.

pGRN134

The EcoRI fragment from pGRN121 containing the hTRT coding sequence was inserted into the EcoRI site of pBBS212 so that the antisense of the hTRT coding sequence is expressed under the control of the MPSV promoter. The selectable markers used with this vector are Chlor/HygB/PAC.

pGRN135

Plasmid pGRN126 was digested to completion with MscI and SmaI and religated to delete over 95% of the hTRT coding sequence inserted. One SmaI-MscI fragment was re-inserted during the process to recreate the Cat activity for selection. This unpurified plasmid was then redigested with SalI and EcoRI and the fragment containing the initiating codon of the hTRT coding sequence was inserted into the SalI-EcoRI sites of pBBS212. This makes an antisense expression plasmid expressing the antisense of the 5'UTR and 73 bases of the coding sequence. The selectable markers used with this vector are Chlor/HygB/PAC.

pGRN136

The HindIII-SalI fragment from pGRN126 containing the hTRT coding sequence was inserted into the HindIII-SalI sites of pBBS242.

pGRN137

The SalI-Sse8387I fragment from pGRN130 containing the Kozak sequence was inserted into the SalI-Sse83871 sites of pGRN136.

pGRN138

The EcoRI fragment from pGRN124 containing hTRT minus the 3UTR was inserted into the EcoRI site of pEGFP-C2 such that the orientation of the hTRT is the same as the EGFP domain.

pGRN139

The oligonucleotide 5'-CTGCCCTCAGACTTCAA-GACCATCCTGGACTACAAGG ACGACGATGA-CAAATGAATTCAGATCTGCGGCCGCCAC-CGCGGTGGAGCTCCAG C-3' (SEQ ID NO:614) was used to insert the IBI Flag at the C-terminus of hTRT in pGRN125 and create EcoRI and BglII sites for cloning.

Also, COD2866 was used to convert AmpS to AmpR and COD1941 was used to convert CatR to CatS.

pGRN140

The NcoI fragment containing the upstream sequences of genomic hTRT and the first intron of hTRT from lambdaG55 was inserted into the NcoI site of pBBS 167. The fragment is oriented so that hTRT is in the same direction as the Lac promoter.

pGRN141

The NcoI fragment containing the upstream sequences of genomic hTRT and the first intron of hTRT from lambdaG55 was inserted into the NcoI site of pBBS167. The fragment is oriented so that hTRT is in the opposite direction as the Lac promoter.

pGRN142

The NotI fragment from lambdaGphi5 containing the complete ~15 kbp genomic insert including the hTRT gene promoter region was inserted in the NotI site of plasmid pBBS185. The fragment is oriented so that the hTRT ORF is in the opposite orientation as the Lac promoter.

pGRN143

The NotI fragment from lambdaGphi5 containing the complete ~15 kbp genomic insert including the hTRT gene promoter region was inserted in the NotI site of plasmid pBBS185. The fragment is oriented so that the hTRT ORF is in the same orientation as the Lac promoter.

pGRN144

SAL1 deletion of pGRN140 to remove lambda sequences.

pGRN145

This vector was constructed for the expression of hTRT sequences in mammalian cells. The EcoRI fragment from pGRN137 containing the hTRT coding sequence was inserted into the EcoRI site of pBBS212 to remove the portion of the sequence corresponding to the 5'UTR of hTRT mRNA. The hTRT coding sequence is oriented so that it is expressed under the control of the MPSV promoter. The selectable markers used with this vector are Chlor/HygB/PAC.

pGRN146

This vector was constructed for the expression of hTRT sequences in mammalian cells. The Sse83871-NotI fragment from pGRN130 containing the D869A mutation of hTRT was inserted into the Sse8387I-NotI sites of pGRN137. The selectable markers used with this vector are Ampicillin/HygB/PAC.

pGRN147

The Sse8387]-NotI fragment from pGRN139 containing the IBI Flag was inserted into the Sse8387'-NotI sites of pGRN137.

pGRN148

The BglII-Eco47III fragment from pGRN144 containing the promoter region of hTRT was inserted into the BglII-NruI sites of pSEAP2 to make an hTRT promoter/reporter construct.

pGRN149

This vector is an intermediate vector for constructing a hTRT fusion protein expression vector. The mutagenic oligo 5'-cttcaagaccatcctggactttcgaaacgcggccgccaccg cggtg-gagctcc-3' (SEQ ID NO:615) was used to add a CSP45I site at the C-terminus of hTRT by in vitro mutagenesis of pGRN125. The "stop" codon of hTRT was deleted and replaced with a Csp45I site. The selectable marker that is used with this vector is ampicillin.

pGRN150

The BglII-FspI fragment from pGRN144 containing the promoter region of hTRT was inserted into the BglII-NruI sites of pSEAP2 to make an hTRT promoter/reporter construct.

pGRN151

This vector was constructed for the expression of hTRT sequences in mammalian cells. The EcoRI fragment from pGRN147 containing the hTRT coding sequence was inserted into the EcoRI site of pBBS212 to remove the portion of the sequence corresponding to the 5'UTR of the hTRT mRNA. The hTRT coding sequence is oriented so that it is expressed under the control of the MPSV promoter. The selectable markers used with this vector are Chlor/HygB/PAC.

pGRN152

The EcoRI fragment from pGRN146 containing the hTRT coding sequence was inserted into the EcoRI site of pBBS212 to remove the portion of the sequence corresponding to the 5'UTR of the hTRT. The hTRT coding sequence is oriented so that it is expressed under the control of the MPSV promoter.

pGRN153

The StyI fragment from pGRN130 containing the D869→>A mutation of hTRT (hTRT variant coding sequence) was inserted into the StyI sites of pGRN158 to make a plasmid containing the hTRT coding sequence with a Kozak consensus sequence at its 5'-end, an IBI FLAG sequence at its 3'-end (the C-terminus encoding region), and the D869→A mutation.

pGRN154

The EcoRI fragment of pGRN153 containing the hTRT gene was inserted into the EcoRI site of plasmid pBS212 in an orientation such that the hTRT ORF is oriented in the same direction as the MPSV promoter. This makes an MPSV-directed expression plasmid that expresses the hTRT protein with a Kozak consensus sequence at its amino-terminal end, an IBI FLAG at its carboxy-terminal end, and the D869→A mutation pGRN155

This vector was constructed for the expression of hTRT sequences in mammalian cells. The insert included full length cDNA of hTRT minus 5' and 3' UTR, and Kozak sequences. The 20' EcoRI fragment from pGRN145 containing the hTRT cDNA with the Kozak consensus and no 3' or 5' UTR was inserted into the EcoRI site of p91023(B) such that the hTRT is in the same orientation as the DHFR ORF. This makes a transient expression vector for hTRT. The selectable marker used with this vector is tetracycline.

pGRN156

This vector was constructed for the expression of hTRT sequences in mammalian cells. The EcoRI fragment from pGRN146 containing the D869A mutation of the hTRT cDNA with the Kozak consensus and no 3' or 5' UTR was inserted into the EcoRI site of p91023(B) such that the hTRT is in the same orientation as the DHFR ORF. This makes a transient expression vector for hTRT. The insert included full length cDNA of hTRT minus 5' and 3' UTR, D869A, and Kozak sequences. The selectable marker used with this vector is tetracycline.

pGRN157

This vector was constructed for the expression of hTRT sequences in mammalian cells. The EcoRI fragment from pGRN147 containing the hTRT cDNA with the IBI FLAG at the C-terminus; the Kozak consensus and no 3' or 5' UTR into the EcoRI site of p91023(B) such that the hTRT is in the same orientation as the DHFR ORF. This makes a transient expression vector for hTRT. The insert included full length cDNA of hTRT minus 5' and 3' UTR, the IBI FLAG sequence, and Kozak sequences. The selectable marker used with this vector is tetracycline.

pGRN158

This vector was constructed for the expression and mutagenesis of TRT sequences in E. coli. The EcoRI fragment from pGRN151 containing the hTRT ORF was inserted into the EcoRI site of pBBS183 so that the hTRT ORF is oriented in the opposite direction as the Lac promoter. The insert included full length cDNA of hTRT minus 5' and 3' UTR, IBI FLAG sequence, and Kozak sequences. The hTRT coding sequence is driven by a T7 promoter. The selectable marker used with this vector is amphicillin.

pGRN159

This vector was constructed for the expression and mutagenesis of TRT sequences in E. coli. The NheI-KpnI fragment from pGRN138 containing the EGFP to hTRT fusion was inserted into the XbaI-KpnI sites of pBluescriptIIKS+. This makes a T7 expression vector for the fusion protein (the coding sequence is driven by a T7 promoter). The insert included full length cDNA of hTRT minus the 3' UTR as a fusion protein with EGFP. The selectable marker used with this vector is amphicillin.

pGRN160

This vector was constructed for the expression of antisense hTR sequences in mammalian cells. The coding sequence is operably linked to an MPSV promoter. The XhoI-NsiI fragment from pGRN90 containing the full length hTR ORF was inserted into the SalI-Sse8387I sites of pBBS295. This makes a transient/stable vector expressing hTR antisense RNA. A GPT marker was incorporated into the vector. The selectable markers used with this vector are Chlor/gpt/PAC.

pGRN161

This vector was constructed for the expression of sense hTR sequences in mammalian cells. The XhoI-NniI fragment from pGRN89 containing the full length hTR ORF was inserted into the SalI-Sse83871 sites of pBBS295. This makes a transient/stable vector expressing hTR in the sense orientation. The coding sequence is driven by an MPSV promoter. A GPT marker was incorporated into the vector. The selectable markers used with this vector are Chlor/gpt/PAC.

pGRN162

The XhoI-NsiI fragment from pGRN87 containing the full length hTR ORF was inserted into the SalI-Sse8387I sites of pBBS295. This makes a transient/stable vector expressing truncated hTR (from position +108 to +435) in the sense orientation.

pGRN163

This vector was constricted for the expression and mutagenesis of TRT sequences in E. coli. The coding sequence is driven by a T7 promoter. Oligonucleotide RA45 (5'-GCCACCCCCGCGCTGCCTCGAGCTC-CCCGCTGC-3'; SEQ ID NO:616) is used in in vitro mutagenesis to change the initiating met in hTRT to Leu and introduce an XhoI site in the next two codons after the Leu. Also COD 1941 was used to change CatR to CatS, and introduces a BSPH1 site, and COD 2866 was used to change AmpS to AmpR, introducing an FSP1 site. The selectable marker used with this vector is amphicillin.

pGRN164

This vector was constructed for the expression of hTR sequences in E. coli. Primers hTR+1 5'-GGGGAAGCTT-TAATACGACTCACTATAGGGTTGCGGAGGGTGG GCCTG-3' (SEQ ID NO:617) and hTR+445 5'-CCCCG-GATCCTGCGCATGTGTGAGCCGAGTCCT GGG-3' (SEQ ID NO:618) were used to amplify by PCR a fragment from pGRN33 containing the full length hTR with the T7 promoter on the 5' end (as in hTR+1). A BamHI-HindIII digest of the PCR product was put into the BamHI-HindIII sites of pUC119. The coding sequence operably linked to a T7 promoter. The selectable marker used with this vector is amphicillin. pGRN164 is also called phTR+1.

pGRN165

This vector was constructed for the expression and mutagenesis of hTRT sequences in E. coli. The coding sequence is operably linked to a T7 promoter. The EcoRI fragment from pGRN145 containing the hTRT ORF with a Kozak front end was inserted into the EcoRI site of pBluescriptIISK+ so that the hTRT is oriented in the same direction as the T7 promoter. The selectable marker used with this vector is amphicillin.

pGRN166

This vector was constructed for the expression and mutagenesis of TRT sequences in mammalian cells. The coding sequence is operably linked to a T7 promoter. The EcoRI fragment from pGRN151 containing the hTRT ORF with a Kozak front end and IBI flag at the back end was inserted into the EcoRI site of pBluescriptIISK+ so that the hTRT ORF is oriented in the same direction as the T7 promoter. The insert included full length cDNA of hTRT minus 5' and 3' UTR, FLAG sequence (Immunex Corp, Seattle Wash.), and Kozak sequences. The selectable marker used with this vector is amphicillin.

pGRN167

AvRII-StuI fragment from pGRN144 containing the 5' end of the hTRT ORF was inserted into the XbaI-StuI sites of pBBS161.

pGRN168

The EcoRI fragment from pGRN145 containing the optimized hTRT expression cassette was inserted into the EcoRI site of pIND such that the hTRT coding sequence is in the same orientation as the miniCMV promoter.

pGRN169

The EcoRI fragment from pGRN145 containing the optimized hTRT expression cassette was inserted into the EcoRI site of pIND such that the hTRT is in the reverse orientation from the miniCMV promoter.

pGRN170

The EcoRI fragment from pGRN145 containing the optimized hTRT expression cassette was inserted into the EcoRI site of pIND(sp1) such that the hTRT is in the opposite orientation from the miniCMV promoter.

pGRN171

The Eco47III-NarI fragment from pGRN163 was inserted into the Eco47III-NarI sites of pGRN167, putting the MIL mutation into a fragment of the hTRT genomic DNA.

pGRN172

The BamHI-StuI fragment from pGRN171 containing the Met to Leu mutation in the hTRT ORF was inserted into the BglII-NruI sites of pSEAP2-Basic.

pGRN173

The EcoRV-ECO47III fragment from pGRN144 containing the 5' end of the hTRT promoter region was inserted into the SrfI-Eco47III sites of pGRN172. This makes a promoter reporter plasmid that contains the promoter region of hTRT from approximately 2.3 kb upstream from the start of the hTRT ORF to just after the first intron in the coding region, with the Met1→Leu mutation.

pGRN174

The EcoRI fragment from pGRN145 containing the "optimized" hTRT expression cassette was inserted into the EcoRI site of pIND(sp1) such that the hTRT is in the same orientation as the miniCMV promoter.

Example 7

Reconstitution of Telomerase Activity

A. Co-Expression of hTRT and hTR In Vitro

In this example, the coexpression of hTRT and hTR using an in vitro cell-free expression system is described. These results demonstrate that the hTRT polypeptide encoded by pGRN121 encodes a catalytically active telomerase protein and that in vitro reconstitution (IVR) of the telomerase RNP can be accomplished using recombinantly expressed hTRT and hTR.

Telomerase activity was reconstituted by adding linearized plasmids of hTRT. (pGRN121; 1 μDNA digested with Xba I) and hTR (phTR+1; 1 μg digested with FspI) to a coupled transcription-translation reticulocyte lysate system (Promega TNT™). phTR+1 is a plasmid which, when linearized with FspI and then transcribed by T7 RNA polymerase, generates a 445 nucleotide transcript beginning with nucleotide +1 and extending to nucleotide 446 of hTR (Autexier et al., 1996, *EMBO J.* 15:5928). For a 50 μl reaction the following components were added: 2 μl TNT™ buffer, 1 μl TNT™ T7 RNA polymerase, 1 μl 1 mM amino acid mixture, 40 units Rnasin™ RNase inhibitor, 1 μg each linearized template DNA, and 25 μl TNT™ reticulocyte lysate. Components were added in the ratio recommended by the manufacturer and were incubated for 90 min at 30° C. Transcription was under the direction of the T7 promoter and could also be carried out prior to the addition of reticulocyte lysate with similar results. After incubation, 5 and 10 μl of the programmed transcription-translation reaction were assayed for telomerase activity by TRAP as previously described (Autexier et al., supra) using 20 cycles of PCR to amplify the signal.

Figure 10A:
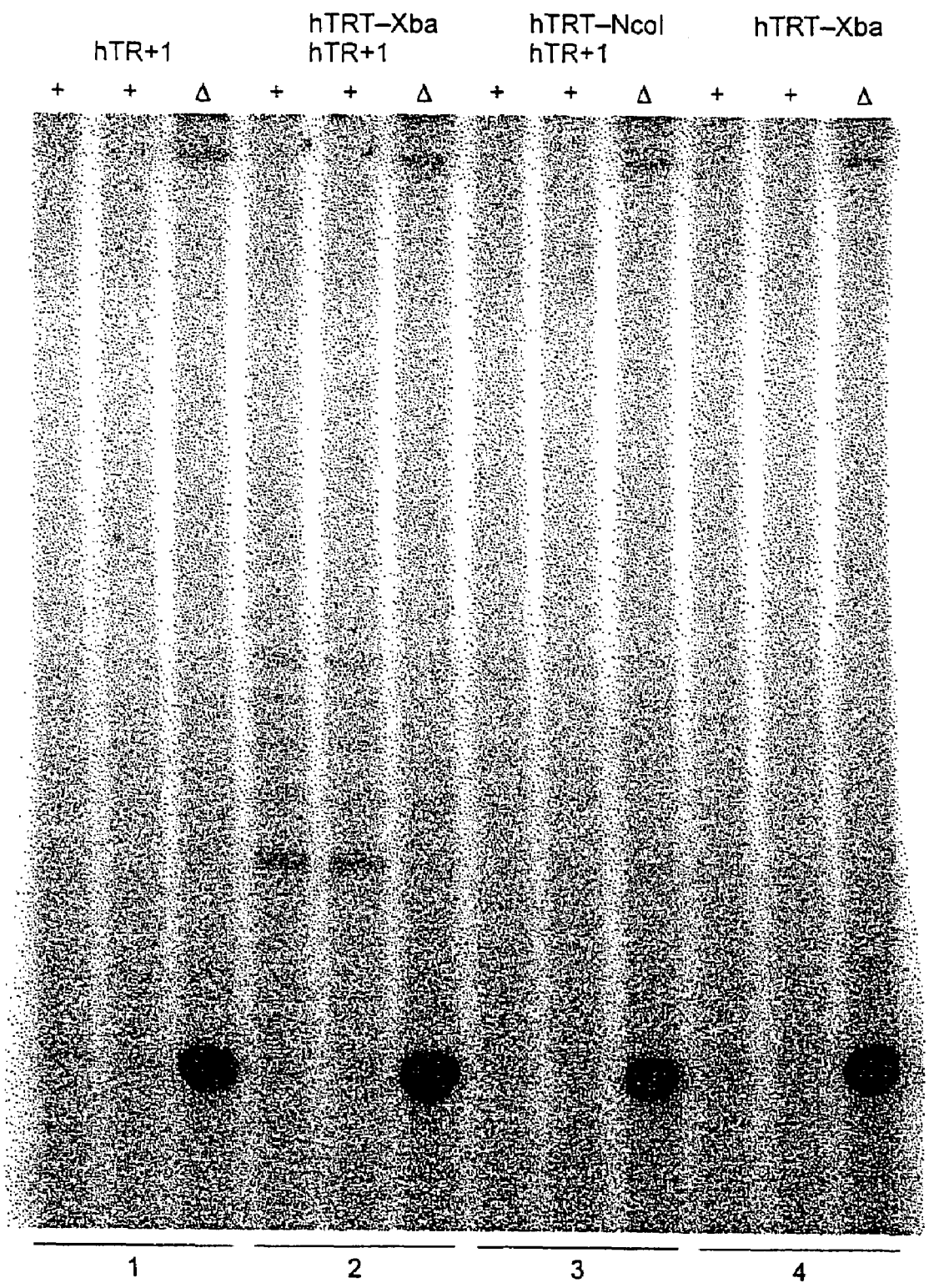
FIGS. 10A and 10B show coexpression in vitro of hTRT and hTR to produce catalytically active human telomerase.
Figure 10B:
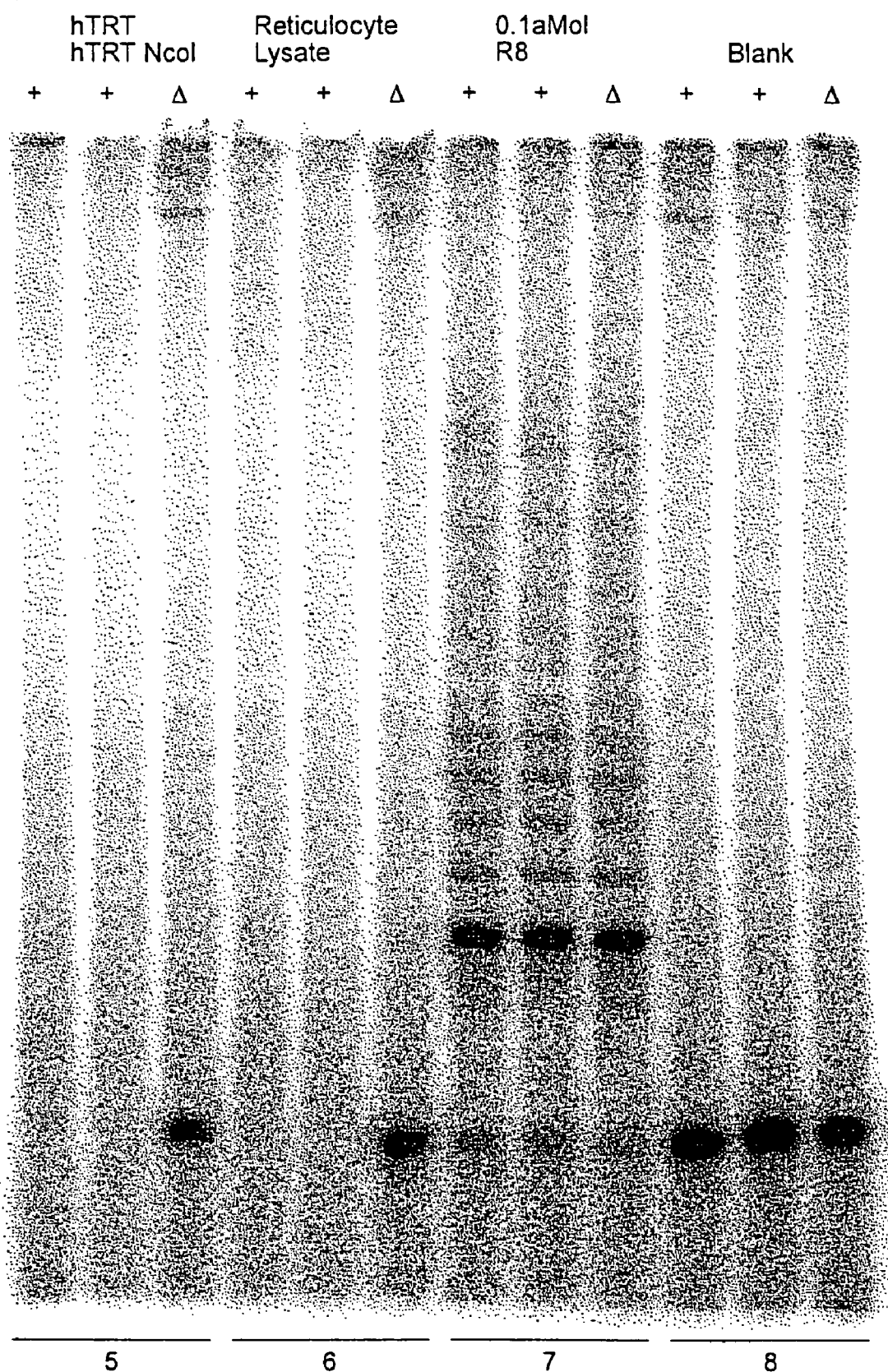

The results of the reconstitution are shown in FIG. 10. For each transcription/translation reaction assayed there are 3 lanes: The first 2 lanes are duplicate assays and the third lane is a duplicate sample heat denatured (95° C., 5 min) prior to the TRAP phase to rule out PCR generated artifacts.

As shown in FIG. 10, reticulocyte lysate alone has no detectable telomerase activity (lane 6). Similarly, no detectable activity is observed when either hTR alone (lane 1) or full length hTRT gene (lane 4) are added to the lysate. When both components are added (lane 2), telomerase activity is generated as demonstrated by the characteristic repeat ladder pattern. When the carboxyl-terminal region of the hTRT gene is removed by digestion of the vector with NcoI ("truncated hTRT") telomerase activity is abolished (lane 3). Lane 5 shows that translation of the truncated hTRT alone does not generate telomerase activity. Lane "R8" shows a positive control for a telomerase product ladder generated by TRAP of TSR8, a synthetic telomerase product having a nucleotide sequence of 5'-ATTCCGTCGAGCAGAGTTAG [GGTTAG]$_7$-3' (SEQ ID NO:619).

It was also observed that purification of IVR telomerase resulted in a stronger signal and/or reduced background in certain telomerase activity assays. In some experiments, IVR telomerase activity from co-synthesized components was enriched by fractionation of T$_N$T reactions over DEAE anion exchange membranes (Millipore Ultrafree-MC): 200 μl of the hTRT/hTR T$_N$T reaction was passed through a single DEAE membrane. The membrane was washed with 400 μl of 0.2 M NaCl in buffer A (20 mM HEPES-KOH pH 7.9, 2 mM MgCl$_2$, 1 mM EGTA, 10% glycerol, 0.1% Nonidet P-40, 0.1 mM phenylmethylsulfonyl fluoride) and IVR telomerase was eluted from the membrane with 80 μl of 1 M NaCl in buffer A. Alternatively, batch chromatography was used: 400 μl of the T$_N$T reaction was partially purified by batch chromatography using 25 μl of Toso-Haas Q-650M resin. After binding telomerase to the resin, it was washed with 0.1 M NaCl in buffer A, followed by a second wash with 0.18 M NaCl in buffer A and eluted with 100 μl of 0.3 M NaCl in buffer A.

B. Mixing of hTRT and hTR in vitro

In vitro reconstitution of telomerase activity was also accomplished by mixing. hTRT was transcribed and translated as described supra, but without the addition of the hTR plasmid. Reconstitution of the telomerase RNP was then accomplished by mixing the hTRT translation mixture with hTR (previously generated by T7 RNA polymerase transcription from phTR+1-Fsp) in the ratio of 2 μl of hTRT translation mix to 2 μl of hTR (1 ug) then incubated for 90 minutes at 30° C. The reaction conditions were adjusted to a KCl concentration of about 0.2 M. (The presence of KCl at a concentration of about 0.1 M to about 1.0 M may enhance telomerase activity or telomerase reconstitution in IVR). This method of hTRT/hTR reconstitution is referred to as "linked reconstitution" or "linked IVR." Telomerase activity is present (i.e., can be detected) in this mixture. Improved signal was observed following partial purification of the activity by DEAE chromatography. In this case Millipore Ultrafree-MC DEAE, Centrifugal Filter Devices were used according to the manufacturer's directions). The buffers used were hypo0.1, hypo0.2, and hypo 1.0, where hypo is 20 mM Hepes-KOH, pH 7.9, 2 mM MgCl$_2$, 1 mM EGTA, 10% glycerol, 0.1% NP-40, 1 mM DTT, 1 mM Na-metabisulfite, 1 mM benzamidine, and 0.2 mM phenylmethylsulfonylflouride (PMSF), and where 0.1, 0.2 and 1.0 refers to 0.1, 0.2 or 1.0 M KCL. The filters were preconditioned with hypo1.0, washed with hypo0.1, the reconstituted telomerase was loaded, the column was washed with hypo0.1 then hypo0.2, and the reconstituted telomerase was eluted with hypo1.0 at half the volume as was loaded. This formulation could be stored frozen at −70° C. and retains activity.

Telomerase activity was assayed in a two step procedure. In step one, a conventional telomerase assay was performed as described in Morin, 1989, *Cell* 59: 521, except no radiolabel was used. In step two, an aliquot was assayed by the TRAP procedure for 20-30 cycles as described supra. The conventional assay was performed by assaying 1-10 μl of reconstituted telomerase in 40-50 μl final volume of 25 mM Tris-HCl, pH 8.3, 50 mM K-acetate, 1 mM EGTA, 1 mM MgCl$_2$, 2 mM dATP, 2 mM TTP, 10 uM dGTP, and 1 uM primer (usually M2,5'-AATCCGTCGAGCAGAGTT; SEQ ID NO:620) at 30° C. for 60-180 minutes. The reaction was stopped by heating to 95° C. for 5 minutes and 1-10 µL of the first step mixture was carried onto the step two TRAP reaction (50 ul).

In additional experiments, the synthesis of hTRT and hTR during in vitro reconstitution was monitored by $^{35}$S-methionine incorporation and Northern blotting, respectively. Proteins of approximately the predicted size were synthesized for hTRT (127 kD), hTRT-Nco (85 kD), and pro90hTRT (90 kD) in approximately equal molar amounts relative to each other. The Northern analysis indicated hTR synthesis was the correct size (445 nucleotides) and predominantly intact.

High levels of reconstitution and telomerase activity were also obtained with 2 µg of linearized pGRN121 in a 50 µl TnT reaction as described supra (Example 7A) except that in place of the hTR template, 4 pmol (0.6 µg) of hTR RNA (previously generated by T7 RNA polymerase transcription from phTR+1-Fsp) was added at the beginning of the TnT reaction and the reaction was incubated at 30EC for 90-120 minutes. Slightly greater (2-5 times) activity was achieved using 1 µg of supercoiled XhTRT- and 16 pmol (2.4 µg) of pre-synthesized hTR RNA set up in a 50 µl TnT reaction, as described supra, with incubation at 30EC for 90-120 minutes. XhTRT-E is an hTRT construct in the pcDNA3.1/His Xpress vector (Invitrogen) in which an optimized ribosome recognition site (Kozak consensus), six histidine residues, and an epitope tag are fused with the hTRT open reading frame.

Variations of the reconstitution protocols, supra, will be apparent to those of skill. For example, the time and temperature of reconstitution, and presence or concentration of components such as monovalent salt (e.g. NaCl, KCl, potassium acetate, potassium glutamate, and the like), divalent salt (MgCl$_2$, MnCl$_2$, MgSO$_4$, and the like), denaturants (urea, formamide, and the like), detergents (NP-40, Tween, CHAPS, and the like), and alternative improved purification procedures (such as immunoprecipitation, affinity or standard chromatography) can be employed. These and other parameters can be varied in a systematic way to optimize conditions for particular assays or other reconstitution protocols.

C. Reconstitution Using hTRT Variants and Fusion Proteins

Reconstitution of telomerase catalytic activity occurred when EGFP-hTRT, a fusion of the enhanced green fluorescent protein to hTRT (see Examples 6 and 15), or epitope-tagged hTRT (IBI FLAG, see Example 6) both reconstituted telomerase activity at approximately wild-type levels were coexpressed with hTR.

In contrast, telomerase activity was not reconstituted when a variant hTRT, pro90hTRT (missing RT motifs B', C, D, and E) was used. This demonstrates that pro90hTRT does not possess full telomerase catalytic activity, although it may have other partial activities (e.g., RNA [i.e. hTR] binding ability and function as dominant-negative regulator of telomerase in vivo as described supra).

D. Assay of in vitro Reconstituted Telomerase Activity Using the Gel Blot and Conventional Telomerase Assay The following example demonstrates that in vitro reconstituted (IVR) telomerase can be assayed using conventional telomerase assays in addition to amplification-based assays (i.e., TRAP). IVR telomerase as described in part (B), supra (the "linked reconstitution method") followed by DEAE purification, as described supra was assayed using the gel blot assay using the following reaction conditions; 1-10 µl of linked IVR telomerase in 40 µl final volume of 25 mM Tris-HCl, pH 8.3, 50 mM K-acetate, 1 mM EGTA, 1 mM MgCl$_2$, 0.8 mM dATP, 0.8 mM TTP, 1.0 mM dGTP, and 1 uM primer (M2, supra; or H3.03, 5'-TTAGGGTTAGGGT-TAGGG; SEQ ID NO:621) at 30° C. for 180 minutes. The telomeric DNA synthesized was isolated by standard procedures, separated on a 8% polyacrylamide, 8 M urea gel, transferred to a nylon membrane, and probed using the $^{32}$P-(CCCTAA)n riboprobe used in the dot-blot assay. The probe identified a six nucleotide ladder in the lane representing 10 µl of IVR telomerase that was equivalent to the ladder observed for 5 µl of native nuclear telomerase purified by mono Q and heparin chromatography. The results show that IVR telomerase possesses processive telomerase catalytic activity equivalent to native telomerase.

Linked IVR telomerase was also assayed by the conventional $^{32}$P-dGTP incorporation telomerase assay. IVR telomerase prepared by the linked reconstitution method followed by DEAE purification, as described above, was assayed under both processive and non-processive reaction conditions. Assay conditions were 5-10 µl of linked IVR telomerase in 40 µl final volume of 25 mM Tris-HCl, pH 8.3, 50 mM K-acetate, 1 mM EGTA, 1 mM MgCl$_2$, 2 mM dATP, 2 mM TTP, with 10 uM $^{32}$P-dGTP (72 Ci/mmol) [for assay of processive conditions] or 1 uM $^{32}$P-dGTP (720 Ci/mmol) [for non-processive], and 1 uM primer (i.e., H3.03, supra) at 30° C. [for the processive reaction] or 37° C. [for the non-processive reaction] for 180 minutes. The telomeric DNA synthesized was isolated by standard procedures and separated on a 8% polyacrylamide, 8 M urea gel sequencing gel. The processive reaction showed a weak six nucleotide ladder consistent with a processive telomerase reaction, and the non-processive reaction added one repeat, a pattern equivalent to a control reaction with a native telomerase preparation. Conventional assays using IVR telomerase are useful in screens for telomerase modulators, as described herein, as well as other uses such as elucidation of the structural and functional properties of telomerase.

E. In vitro Reconstituted Telomerase Recognizes Primer 3' Termini

This experiment demonstrates that IVR telomerase recognizes primer 3' termini equivalently to native (purified) telomerase. Telomerase forms a base-paired duplex between the primer 3' end and the template region of hTR and adds the next specified nucleotide (Morin, 1989, supra). To verify that IVR (recombinant) telomerase has the same property, the reactions of primers with—GGG or—TAG 3' termini (AATCCGTCGAGCAGAGGG; SEQ ID NO:622 and AATCCGTCGAGCAGATAG; SEQ ID NO:623) were compared to a primer having a—GTT 3' terminus (M2 supra) using IVR and native telomerase assayed by the two step conventional/TRAP assay detailed above. The product ladders of the—GGG and—TAG primers were shifted +4 and +2, respectively, when compared to the standard primer (—GTT3' end), the same effect as was observed with native telomerase. This experiment demonstrates IVR and native telomerases recognize primer termini in a similar manner.

These results (along with the results supra showing that IVR telomerase possesses both processive and non-processive catalytic activity) indicate that IVR telomerase has similar structure and properties compared to native or purified telomerase.

Example 8

Production of Anti-hTRT Antibodies

A. Production of Anti-hTRT Antibodies Against hTRT Peptides

To produce anti-hTRT antibodies, the following peptides from hTRT were synthesized with the addition of C (cysteine) as the amino terminal residue (see FIG. 54).

S-1: FFY VTE TTF QKN RLF FYR KSV WSK SEQ ID NO:232

S-2: RQH LKR VQL RDV SEA EVR QHR EA SEQ ID NO:233

S-3: ART FRR EKR AER LTS RVK ALF SVL NYE SEQ ID NO:234

A-3: PAL LTS RLR FIP KPD GLR PIV NMD YVV SEQ ID NO:237

The cysteine moiety was used to immobilize (i.e., covalently link) the peptides to BSA and KLH [keyhole limpet hemocyanin] carrier proteins. The KLH-peptides were used as antigen. The BSA-peptide conjugates served as material for ELISAs for testing the specificity of immune antisera.

The KLH-peptide conjugates were injected into New Zealand White rabbits. The initial injections are made by placing the injectant proximal to the axillary and inguinal lymph nodes. Subsequent injections were made intramuscularly. For initial injections, the antigen was emulsified with Freund's complete adjuvant; for subsequent injections, Freund's incomplete adjuvant was used. Rabbits follow a three week boost cycle, in which 50 ml of blood yielding 20-25 ml of serum is taken 10 days after each boost. Antisera against each of the four peptides recognized the hTRT moiety of recombinant hTRT fusion protein (GST-HIS$_8$-hTRT-fragment 2426 to 3274); see Example 6) on western blots.

Using a partially purified telomerase fraction from human 293 cells (approximately 1000-fold purification compared to a crude nuclear extract) that was produced as described in PCT application No. 97/06012 and affinity purified anti-S-2 antibodies, a 130 kd protein doublet could be detected on a western blot. A sensitive chemiluminescence detection method was employed (SuperSignal chemiluminescence substrates, Pierce) but the signal on the blot was weak, suggesting that hTRT is present in low or very low abundance in these immortal cells. The observation of a doublet is consistent with a post-translational modification of hTRT, i.e., phosphorylation or glycosylation.

For affinity purification, the S-2 peptide was immobilized to SulfoLink (Pierce, Rockford Ill.) through its N-terminal Cysteine residue according to the manufacturer's protocol. First bleed serum from a rabbit immunized with the KLH-S-2 peptide antigen was loaded over a the S-2-SulfoLink and antibodies specifically bound to the S-2 peptide were eluted.

B. Production of Anti-hTRT Antibodies Against hTRT Fusion Proteins

GST-hTRT fusion proteins were expressed in *E. coli* as the GST-hTRT fragment #4 (nucleotides 3272-4177) and the GST-HIS8-hTRT fragment #3 (nucleotides 2426 to 3274) proteins described in Example 6. The fusion proteins were purified as insoluble protein, and the purity of the antigens was assayed by SDS polyacrylamide gels and estimated to be about 75% pure for the GST-hTRT fragment #4 recombinant protein and more than 75% pure for GST-HIS8-hTRT fragment #3 recombinant protein. Routine methods may be used to obtain these and other fusion proteins at a purity of greater than 90%. These recombinant proteins were used to immunize both rabbits and mice, as described above.

The first and second bleeds from both the mice and rabbits were tested for the presence of anti-hTRT antibodies after removal of anti-GST antibodies using a matrix containing immobilized GST. The antisera were tested for anti-hTRT antibodies by Western blotting using immobilized recombinant GST-hTRT fusion protein, and by immunoprecipitation using partially purified native telomerase enzyme. While no signal was observed in these early bleeds, titers of anti-hTRT antibodies, as expected, increased in subsequent bleeds.

Example 9

Detection of an hTRT mRNA Corresponding to Δ182 RNA Variant

Poly A$^+$ RNA from human testis and the 293 cell line was analyzed for hTRT mRNA using RT-PCR and nested primers. The first primer set was TCP1.1 and TCP1.15; the second primer set was TCP1.14 and BTCP6. Amplification from each gave two products differing by 182 bp; the larger and smaller products from testis RNA were sequenced and found to correspond exactly to pGRN121 (FIG. 16) and the 712562 clone (FIG. 18), respectively. The variant hTRT RNA product has been observed in mRNA from SW39i, OVCAR4, 293, and Testes.

Additional experiments were carried out to demonstrate that the Δ182 cDNA was not an artifact of reverse transcription. Briefly, full-length hTRT RNA (i.e., without the deletion) was produced by in vitro transcription of pGRN121 for use as a template for RT-PCR. Separate cDNA synthesis reactions were carried out using Superscript7 reverse transcriptase (Bethesda Research Laboratories, Bethesda Md.) at 42° or 50° C., and with random-primers or a specific primer. After 15 PCR cycles the longer product was detectable; however, the smaller product (i.e., corresponding to the deletion) was not detectable even after 30 or more cycles. This indicates that the RT-PCR product is not an artifact.

Example 10

Sequencing of Testis hTRT mRNA

The sequence of the testis form of hTRT RNA was determined by direct manual sequencing of DNA fragments generated by PCR from testis cDNA (Marathon Testes cDNA, Clontech, San Diego Calif.) using a ThermoSequenase radiolabeled terminator cycle sequencing kit (Amersham Life Science). The PCR step was performed by a nested PCR, as shown in Table 8. In all cases a negative control reaction with primers but no cDNA was performed. The absence of product in the control reaction demonstrated that the products derived from the reaction with cDNA present were not due to contamination of hTRT from pGRN121 or other cell sources (e.g., 293 cells). The DNA fragments were excised from agarose gels to purify the DNA prior to sequencing.

The testis mRNA sequence corresponding to bases 27 to 3553 of the pGRN121 insert sequence, and containing the entire hTRT ORF (bases 56 to 3451) was obtained. There were no differences between the testis and the pGRN121 sequences in this region.

TABLE 8

| Fragment | Primer Set 1 | Primer Set 2 | Final Size | Primers for Seq |
|---|---|---|---|---|
| OA | na | K320/ K322 | 208 | K320, K322 |
| A | K320/ TCP1.43 | TCP1.40/ TCP1.34 | 556 | TCP1.52, TCP1.39, K322, TCP1.40, TCP1.41, TCP1.30, TCP1.34, TCP1.49 |
| B | TCP1.42/ TCP1.32B | TCP1.35/ TCP1.21 | 492 | TCP1.35, TCP1.28, TCP1.38, TCP1.21, TCP1.46, TCP1.33, TCP1.48 |
| C | TCP1.65/ TCP1.66 | TCP1.67/ TCP1.68 | 818 | TCP1.67, TCP1.32, TCP1.69, TCP1.68, TCP1.24, TCP1.44, K303 |
| D2 | K304/ billTCP6 | Lt1/ TCP1.6 | 546 | Lt2, Lt1, TCP1.6, billTCP4, TCP1.13, TCP1.77, TCP1.1 |
| D3 | TCP1.12/ TCP1.7 | TCP1.14/ TCP1.15 | 604 | TCP1.6, TCP1.14, TCP1.73, TCP1.78, TCP1.25, TCP1.15, TCP1.76 |
| EF | na | TCP1.74/ TCP1.7 | 201 | TCP1.74, TCP1.7, TCP1.75, TCP1.15, TCP1.3 |
| E | TCP1.3/ TCP1.4 | TCP1.2/ TCP1.9 | 687 | TCP1.2, TCP1.8, TCP1.9, TCP1.26 |
| F | TCP1.26/ UTR2 | TCP1.10 TCP1.4 | 377 | TCP1.4, TCP1.10, TCP1.11 |

Example 11

Detection of hTRT mRNA by RNASE Protection

RNase protection assays can be used to detect, monitor, or diagnose the presence of an hTRT mRNA or variant mRNA. One illustrative RNAse protection probe is an in vitro synthesized RNA comprised of sequences complementary to hTRT mRNA sequences and additional, non-complementary sequences. The latter sequences are included to distinguish the full-length probe from the fragment of the probe that results from a positive result in the assay: in a positive assay, the complementary sequences of the probe are protected from RNase digestion, because they are hybridized to hTRT mRNA. The non-complementary sequences are digested away from the probe in the presence of RNase and target complementary nucleic acid.

Two RNAse protection probes are described for illustrative purposes; either can be used in the assay. The probes differ in their sequences complementary to hTRT, but contain identical non-complementary sequences, in this embodiment, derived from the SV40 late mRNA leader sequence. From 5'-3', one probe is comprised of 33 nucleotides of non-complementary sequence and 194 nucleotides of sequence complementary to hTRT nucleotides 2513-2707 for a full length probe size of 227 nucleotides. From 5'-3', the second probe is comprised of 33 nucleotides of non-complementary sequence and 198 nucleotides of sequence complementary to hTRT nucleotides 2837-3035 for a full length probe size of 231 nucleotides. To conduct the assay, either probe can be hybridized to RNA, i.e., polyA+ RNA, from a test sample, and T1 ribonuclease and RNase A are then added. After digestion, probe RNA is purified and analyzed by gel electrophoresis. Detection of a 194 nucleotide fragment of the 227 nucleotide probe or a 198 nucleotide fragment of the 231 nucleotide probe is indicative of hTRT mRNA in the sample.

The illustrative RNAse protection probes described in this example can be generated by in vitro transcription using T7 RNA polymerase. Radioactive or otherwise labeled ribonucleotides can be included for synthesis of labeled probes. The templates for the in vitro transcription reaction to produce the RNA probes are PCR products. These illustrative probes can be synthesized using T7 polymerase following PCR amplification of pGRN121 DNA using primers that span the corresponding complementary region of the hTRT gene or mRNA. In addition, the downstream primer contains T7 RNA polymerase promoter sequences and the non-complementary sequences.

For generation of the first RNAse protection probe, the PCR product from the following primer pair (T701 and reverse01) is used:

T701 5'-GGGAGATCT TAATACGACTCACTATAG ATTCA GGCCATGGTG CTGCGCCGGC TGTCA GGCTCCC ACGACGTAGT CCATGTTCAC-3' (SEQ ID NO:624); and reverse01 5'-GGGTCTAGAT CCGGAA- GAGTGT CTGGAGCAAG-3' (SEQ ID NO:625).

For generation of the second RNase protection probe, the PCR product from the following primer pair (T702 and reverse02) is used:

T702 5'-GGGAGATCT TAATACGACTCACTATAG ATTCA GGCCATGGTG CTGCGCCGGC TGTCA GGGCG GCCTTCTGGA CCACGGCATA CC-3' (SEQ ID NO:626); and reverse02 5'-G GTCTAGA CGATATCC ACAGGGCCTG GCGC-3' (SEQ ID NO:672).

Example 12

Figure 6:
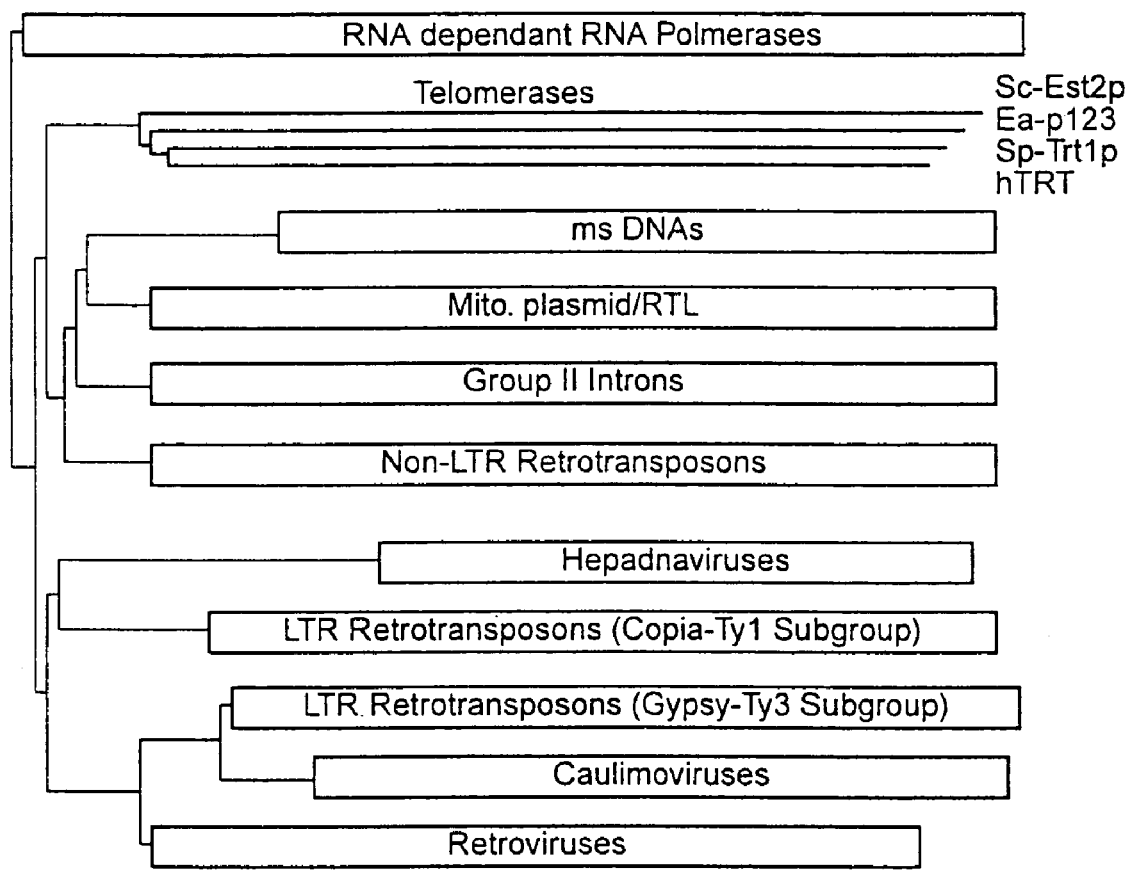
FIG. 6 shows a possible phylogenetic tree of telomerases and retroelements rooted with RNA-dependent RNA polymerases.

Construction of a Phylogenetic Tree Comparing hTRT and Other Reverse Transcriptases A phylogenetic tree (FIG. 6) was constructed by comparison of the seven RT domains defined by Xiong and Eickbush (1990, *EMBO J.* 9:3353). After sequence alignment of motifs 1, 2, and A-E from 4 TRTs, 67 RTs, and 3 RNA polymerases, the tree was constructed using the NJ (Neighbor Joining) method (Saitou and Nei, 1987, *Mol. Biol. Evol.* 4:406). Elements from the same class that are located on the same branch of the tree are simplified as a box. The length of each box corresponds to the most divergent element within that box.

The TRTs appear to be more closely related to RTs associated with msDNA, group II introns, and non-LTR (Long Terminal Repeat) retrotransposons than to the LTR-retrotransposon and viral RTs. The relationship of the telomerase RTs to the non-LTR branch of retroelements is intriguing, given that these latter elements have replaced telomerase for telomere maintenance in *Drosophila*. However, the most striking finding is that the TRTs form a discrete subgroup, almost as closely related to the RNA-dependent RNA polymerases of plus-stranded RNA viruses such as poliovirus as to any of the previously known RTs. Considering that the four telomerase genes come from evolutionarily distant organisms—protozoan, fungi, and mammal—this separate grouping cannot be explained by lack of phylogenetic diversity in the data set. Instead, this deep bifurcation suggests that the telomerase RTs are an ancient group, perhaps originating with the first eukaryote.

GenBank protein identification or accession numbers used in the phylogenetic analysis were: msDNAs (94535, 134069, 134074,134075, 134078), group II introns (483039, 101880, 1332208, 1334433, 1334435, 133345, 1353081), mitochondrial plasmid/RTL (903835, 134084), non-LTR retrotransposons (140023, 84806, 103221, 103353, 134083, 435415, 103015, 1335673, 85020, 141475, 106903, 130402, U0551, 903695, 940390, 2055276, L08889), LTR retrotransposons (74599, 85105, 130582, 99712, 83589, 84126, 479443, 224319, 130398, 130583, 1335652, 173088, 226407, 101042, 1078824), hepadnaviruses (I18876, 1706510, 118894), caulimoviruses (331554, 130600, 130593, 93553), retroviruses (130601, 325465, 74601, 130587, 130671, 130607, 130629, 130589,130631, 1346746, 130651, 130635, 1780973, 130646). Alignment was analyzed using ClustalW 1.5 [J. D. Thompson, D. G. Higgins, T. J. Gibson, Nucleic Acids Res. 22, 4673 (1994)] and PHYLIP 3.5 [J. Felsenstein, Cladisfics 5, 164 (1989)].

Example 13

Transfection of Cultured Human Fibroblasts (BJ) with Control Plasmid and Plasmid Encoding hTRT This example demonstrates that expression of recombinant hTRT protein in a mammalian cell results in the generation of an active telomerase.

Figure 25:
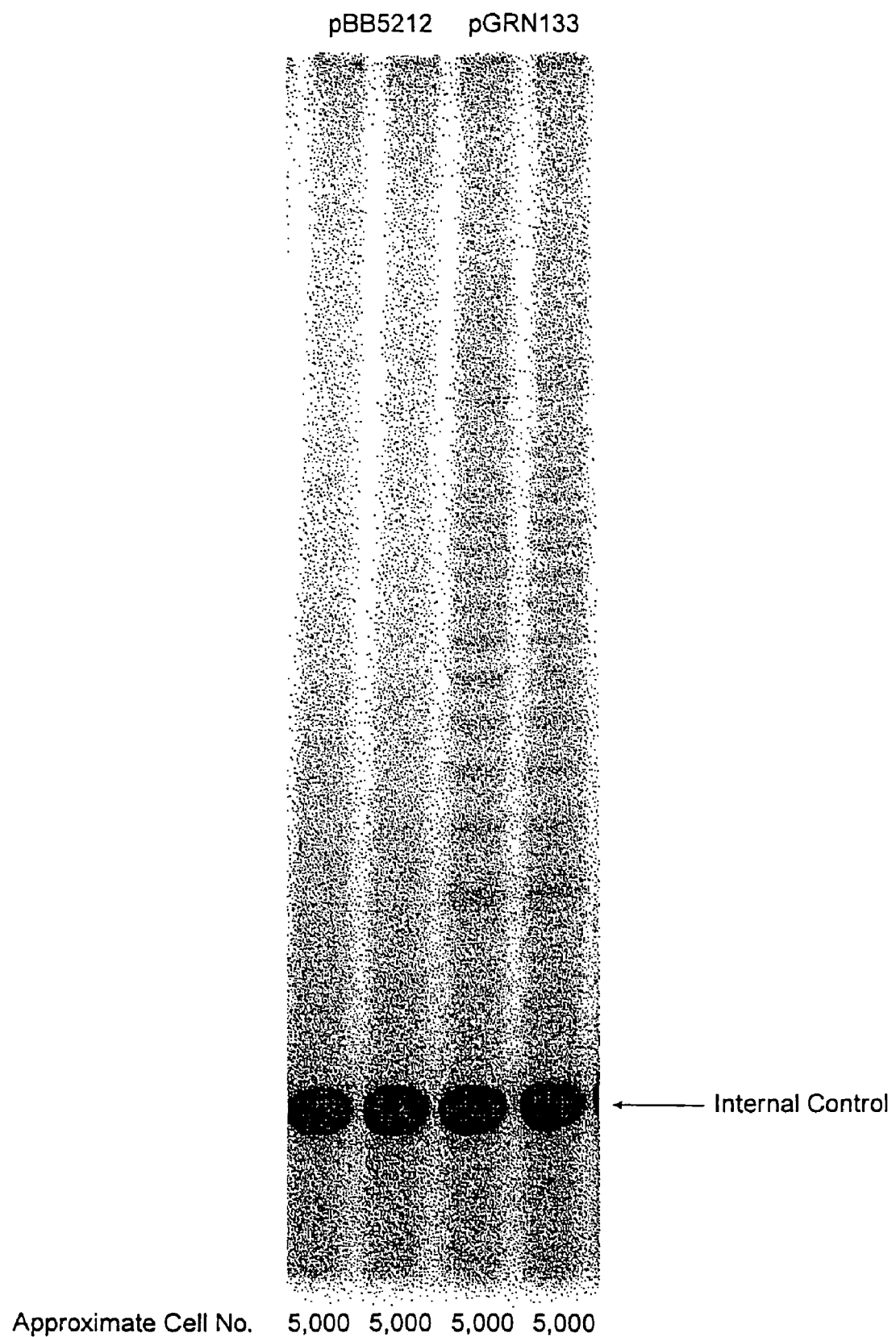
FIG. 25 shows the results of an assay for telomerase activity from BJ cells transfected with an expression vector encoding an hTRT protein (pGRN133) or a control plasmid (pBBS212) as described in Example 13.

Subconfluent BJ fibroblasts were trypsinized and resuspended in fresh medium (DMEM/199 containing 10% Fetal Calf Serum) at a concentration of $4 \times 10^6$ cells/ml. The cells were transfected using electroporation with the BioRad Gene Pulser™ electroporator. Optionally, one may also transfect cells using Superfect™ reagent (Qiagen) in accordance with the manufacturer's instructions. For electroporation, 500 µl of the cell suspension were placed in an electroporation cuvette (BioRad, 0.4 cm electrode gap). Plasmid DNA (2 µg) was added to the cuvettes and the suspension was gently mixed and incubated on ice for 5 minutes. The control plasmid (pBBS212) contained no insert behind the MPSV promoter and the experimental plasmid (pGRN133) expressed hTRT from the MPSV promoter. The cells were electroporated at 300 Volts and 960 µFD. After the pulse was delivered, the cuvettes were placed on ice for approximately 5 minutes prior to plating on 100 mm tissue culture dishes in medium. After 6 hours, the medium was replaced with fresh medium. 72 hours after the transfection, the cells were trypsinized, washed once with PBS, pelleted and stored frozen at −80° C. Cell extracts were prepared at a concentration of 25,000 cells/µl by a modified detergent lysis method (see Bodnar et al., 1996, Exp. Cell Res. 228:58; Kim et al., 1994, Science 266:2011, and as described in patents and publications relating to the TRAP assay, supra) and telomerase activity in the cell extracts was determined using a modified PCR-based TRAP assay (Kim et al., 1994, Bodnar et al., 1996). Briefly, $5 \times 10^4$ cell equivalents were used in the telomerase primer extension portion of the reaction. While the extract is typically taken directly from the telomerase extension reaction to the PCR amplification, one may also extract once with phenol/chloroform and once with chloroform prior to the PCR amplification. One-fifth of the material was used in the PCR amplification portion of the TRAP reaction (approximately 10,000 cell equivalents). One half of the TRAP reaction was loaded onto the gel for analysis, such that each lane in FIG. 25 represents reaction products from 5,000 cell equivalents. Extracts from cells transfected with pGRN133 were positive for telomerase activity while extracts from untransfected (not shown) or control plasmid transfected cells showed no telomerase activity. Similar experiments using RPE cells gave the same result.

Reconstitution in BJ cells was also carried out using other hTRT constructs (i.e., pGRN145, pGRN155 and pGRN138). Reconstitution using these constructs appeared to result in more telomerase activity than in the pGRN133 transfected cells.

The highest level of telomerase activity was achieved using pGRN155. As discussed supra, pGRN155 is a vector containing the adenovirus major late promoter as a controlling element for the expression of hTRT and was shown to reconstitute telomerase activity when transfected into BJ cells.

Notably, when reconstitution using the hTRT-GFP fusion protein pGRN138 (which localizes to the nucleus, see Example 15, infra) was performed either in vitro (see Example 7) or in vivo (transfection into BJ cells) telomerase activity resulted. By transfection into BJ cells, for example, as described supra, telomerase activity was comparable to that resulting from reconstitution in vitro using pGRN133 or pGRN145.

Similar results were obtained upon transfection of normal human retinal pigmented epithelial (RPE) with the hTRT expression vectors of the invention. The senescence of RPE cells is believed to contribute to or cause the disease of age-related macular degeneration. RPE cells treated in accordance with the methods of the invention using the hTRT expression vectors of the invention should exhibit delayed senescence, as compared to untreated cells, and so be useful in transplantation therapies to treat or prevent age-related macular degeneration.

Example 14

Promoter Reporter Construct

This example describes the construction of plasmids in which reporter genes are operably linked to hTRT upstream sequences containing promoter elements. The vectors have numerous uses, including identification of cis and trans transcriptional regulatory factors in vivo and for screening of agents capable of modulating (e.g., activating or inhibiting) hTRT expression (e.g., drug screening). Although a number of reporters may be used (e.g., firefly luciferase, β-glucuronidase, β-galactosidase, chloramphenicol acetyl transferase, and GFP and the like), the human secreted alkaline phosphatase (SEAP; CloneTech) was used for initial experiments. The SEAP reporter gene encodes a truncated form of the placental enzyme which lacks the membrane anchoring domain, thereby allowing the protein to be secreted efficiently from transfected cells. Levels of SEAP activity detected in the culture medium have been shown to be directly proportional to changes in intracellular concentrations of SEAP mRNA and protein (Berger et al., 1988, Gene 66:1; Cullen et al., 1992, Meth. Enzymol. 216:362).

Four constructs (pGRN148, pGRN150, "pSEAP2 basic" (no promoter sequences=negative control) and "pSEAP2 control" (contains the SV40 early promoter and enhancer) were transfected in triplicate into mortal and immortal cells.

Plasmid pGRN148 was constructed as illustrated in FIG. 9. Briefly, a Bgl2-Eco47III fragment from pGRN144 was digested and cloned into the BglII-NruI site of pSeap2Basic (Clontech, San Diego, Calif.). A second reporter-promoter, plasmid pGRN150, includes sequences from the hTRT intron described in Example 3, to employ regulatory sequences that may be present in the intron. The initiating Met is mutated to Leu, so that the second ATG following the promoter region will be the initiating ATG of the SEAP ORF.

The pGRN148 and pGRN150 constructs (which include the hTRT promoter) were transfected into mortal (BJ cells) and immortal (293) cells. All transfections were done in parallel with two control plasmids: one negative control plasmid (pSEAP basic) and one positive control plasmid (pSEAP control which contains the SV40 early promoter and the SV40 enhancer).

In immortal cells, pGRN148 and pGRN150 constructs appear to drive SEAP expression as efficiently as the pSEAP2 positive control (containing the SV40 early promoter and enhancer). In contrast, in mortal cells only the pSEAP2 control gave detectable activity. These results indicate that, as expected, hTRT promoter sequences are active in tumor cells but not in mortal cells.

Similar results were obtained using another normal cell line (RPE, or retinal pigmental epithelial cells). In RPE cells transfected with pGRN150 (containing 2.2 KB of upstream genomic sequence), the hTRT promoter region was inactive while the pSEAP2 control plasmid was active.

As noted supra, plasmids in which reporter genes are operably linked to hTRT upstream sequences containing promoter elements are extremely useful for identification and screening of telomerase activity modulatory agents, using both transient and stable transfection techniques. In one approach, for example, stable transformants of pGRN148 are made in telomerase negative and telomerase positive cells by cotransfection with a eukaryotic selectable marker (such as neo) according to Ausubel et al., 1997, supra. The resulting cell lines are used for screening of putative telomerase modulatory agents, for example, by comparing hTRT-promoter-driven expression in the presence and absence of a test compound.

The promoter-reporter (and other) vectors of the invention are also used to identify trans- and cis-acting transcriptional and translational regulatory elements. Examples of cis-acting transcriptional regulators elements include promoters and enhancers of the telomerase gene. The identification and isolation of cis- and trans-acting regulatory agents provide for further methods and reagents for identifying agents that modulate transcription and translation of telomerase.

To identify sequences or elements that play a role in hTRT expression, expression was tested using promoter-reporter constructs with varying amounts of the upstream region (5' to the transcription initiation site) of the hTRT gene. Experiments were conducted using pGRN 150 [which contains approximately 2405 bp of genomic sequence upstream of the most 5' nucleotide present in the hTRT cDNA], pGRN 176 [which contains approximately 186 bp of genomic sequence upstream of the most 5' nucleotide present in the hTRT cDNA] and pGRN 175 [which contains approximately 77 bp of genomic sequence upstream of the most 5' nucleotide present in the hTRT cDNA]. The following sequence is present in pGRN 176 but not pGRN 175: 5'-GTGGCGGAGGGACTGGGGACCCGGGC ACCG-GTCCTGCCCCTTCACCTTCCAGCTCCGC-CTCGTCCGCGCGGAACCCCGCCC CGTCCCGAAC-CCTTCCCGGGTCCCCGGCCCAGCCCCTTCCGGG-3' (SEQ ID NO:726).

When transfected into mortal cells (RPE and BJ), the pGRN 175 promoter was active, while the pGRN 176 and pGRN 150 promoters were not active. These results demonstrate that the approximately 120 basepair region present in pGRN 176 but not pGRN 175 includes sequences that play a role in the mortal-cell specific repression of hTRT gene expression is achieved. It will be recognized that less than the entire approximately 120 basepair sequence may be required for this effect, and that other sequences not in the approximately 120 base pair region may also play a role (independently or in combination with the approximately 120 base pair region) in regulation of hTRT expression. Thus, the approximately 120 base pair region includes all or part of one or more cis-acting elements.

Without intending to be bound by any particular mechanism, the approximately 120 base pair sequence includes a binding site for a repressor (e.g., a trans acting repressor) which upon binding prevents initiation of transcription of the hTRT gene. Such a repressor may be the product of an anti-oncogene (e.g., a novel anti-oncogene), which can be identified and cloned in accordance with the teachings herein and the use of the novel reagents disclosed herein. In normal cells, repressor binding or interaction with hTRT regulatory sequences (e.g., including or within the approximately 120 base pair sequence) results in the absence of hTRT protein and therefore of telomerase activity. Activation of telomerase in cancer cells can result from the loss of hTRT repressor activity.

A number of applications of the "approximately 120 base pair region" described above will be immediately apparent upon review of this disclosure, including for treatment or diagnosis of telomerase related diseases and identification of agents with telomerase modulatory activity. For example, using standard techniques, the sequence may be used to identify agents or proteins (e.g. naturally occurring repressor proteins) that specifically bind to the approximately 120 base pair sequence or a subsequence thereof. In addition, synthetic or naturally occurring agents that increase or stabilize repression (e.g., by binding or otherwise interacting with the sequence, by stabilizing binding by a naturally occurring repressor, or by other means) will be useful for reducing telomerase activity in a cell (e.g., for treatment of malignancy). Similarly, agents that reduce repression (e.g., by inhibiting repressor binding, or by other means) will be useful for increasing telomerase expression (e.g., by controlled activation), for example to increase the proliferative capacity of normal cells).

Example 15

Subcellular Localization of hTRT

A fusion protein having hTRT and enhanced green fluorescent protein (EGFP; Cormack et al., 1996, *Gene* 173:33) regions was constructed as described below. The EGFP moiety provides a detectable tag or signal so that the presence or location of the fusion protein can be easily determined. Because EGFP-fusion proteins localize in the correct cellular compartments, this construct may be used to determine the subcellular location of hTRT protein.

A. Construction of pGRN138

A vector for expression of an hTRT-EGFP fusion protein in mammalian cells was constructed by placing the EcoRI insert from pGRN124 (see Example 6) into the EcoRI site of pEGFP-C2 (Clontech, San Diego, Calif.). The amino acid sequence of the fusion protein is provided below. EGFP residues are in bold, residues encoded by the 5' untranslated region of hTRT mRNA are underlined, and the hTRT protein sequence is in normal font.

MVSKGEELFTGVVPILVELDGDVNGHKFSVSGEGEGDATYGKLTLKFICTTGKLPVPWPT

LVTTLTYGVQCFSRYPDHMKQHDFFKSAMPEGYVQERTIFFKDDGNYKTRAEVKFEGDTL

-continued

VNRIELKGIDFKEDGNILGHKLEYNYNSHNVYIMADKQKNGIKVNFKIRHNIEDGSVQLA

DHYQQNTPIGDGPVLLPDNHYLSTQSALSKDPNEKRDHMVLLEFVTAAGITLGMDELYKS

GRTQISSSSFEFAAAST<u>QRCVLLRTWEALAPATPA</u>PRAPRCRAVRSLLRSHYREVLPLA

TFVRRLGPQGWRLVQRGDPAAFRALVAQCLVCVPWDARPPPAAPSFRQVSCLKELVARVL

QRLCERGAKNVLAFGFALLDGARGGPPEAFTTSVRSYLPNTVTDALRGSGAWGLLLRRVG

DDVLVHLLARCALFVLVAPSCAYQVCGPPLYQLGAATQARPPPHASGPRRRLGCERAWNH

SVREAGVPLGLPAPGARRRGGSASRSLPLPKRPRRGAAPEPERTPVGQGSWAHPGRTRGP

SDRGFCVVSPARPAEEATSLEGALSGTRHSHPSVGRQHHAGPPSTSRPPRPWDTPCPPVY

AETKHFLYSSGDKEQLRPSFLLSSLRPSLTGARRLVETIFLGSRPWMPGTPRRLPRLPQR

YWQMRPLFLELLGNHAQCPYGVLLKTHCPLRAAVTPAAGVCAREKPQGSVAAPEEEDTDP

RRLVQLLRQHSSPWQVYGFVRACLRRLVPPGLWGSRHNERRFLRNTKKFISLGKHAKLSL

QELTWKMSVRDCAWLRRSPGVGCVPAAEHRLREEILAKFLHWLMSVYVVELLRSFFYVTE

TTFQKNRLFFYRPSVWSKLQSIGIRQHLKRVQLRELSEAEVRQHREARPALLTSRLRFIP

KPDGLRPIVNMDYVVGARTFRREKRAERLTSRVKALFSVLNYERARRPGLLGASVLGLDD

IHRAWRTFVLRVRAQDPPPELYFVKVDVTGAYDTIPQDRLTEVIASIIKPQNTYCVRRYA

VVQKAAHGHVRKAFKSHVSTLTDLQPYMRQFVAHLQETSPLRDAVVIEQSSSLNEASSGL

FDVFLRFMCHHAVRIRGKSYVQCQGIPQGSILSTLLCSLCYSDMENKLFAGIRRDGLLLR

LVDDFLLVTPHLTHAKTFLRTLVRGVPEYGCVVNLRKTVVNFPVEDEALGGTAFVQMPAH

GLFPWCGLLLDTRTLEVQSDYSSYARTSIRASVTFNRGFKAGRNMRRKLFGVLRLKCHSL

FLDLQVNSLQTVCTNIYKILLLQAYRFHACVLQLPFHQQVWKNPTFFLRVISDTASLCYS

ILKAKNAGMSLGAKGAAGPLPSEAVQWLCHQAFLLKLTRHRVTYVPLLGSLRTAQTQLSR

KLPGTTLTALEAAANPALPSDFKTILD (SEQ ID NO:628)

Other EGFP fusion constructs can be made using partial (e.g., truncated) hTRT coding sequence and used, as described infra, to identify activities of particular regions of the hTRT polypeptide.

B. Nuclear Localization and Uses of pGRN138

Transfection of NIH 293 and BJ cells with pGRN138 confirmed the nuclear localization of recombinantly expressed hTRT. Cells were transfected with pGRN138 (EGFP-hTRT) and with a control construct (expressing EGFP only). Nuclear localization of the EGFP-hTRT is apparent in both cell types by fluorescence microscopy. As noted supra, the pGRN138 hTRT-GFP fusion protein supports reconstitution of telomerase activity in both an in vitro transcription translation system and in vivo when transfected into BJ cells.

The hTRT-EGFP fusion proteins (or similar detectable fusion proteins) can be used in a variety of applications. For example, the fusion construct described in this example, or a construct of EGFP and a truncated form of hTRT, can be used to assess the ability of hTRT and variants to enter a cell nucleus and/or localize at the chromosome ends. In addition, cells stably or transiently transfected with pGRN138 are used for screening compounds to identify telomerase modulatory drugs or compounds. Agents that interfere with nuclear localization or telomere localization can be identified as telomerase inhibitors. Tumor cell lines stably expressing EGFP-hTRT can be useful for this purpose. Potential modulators of telomerase will be administered to these transfected cells and the localization of the EGFP-hTRT will be assessed. In addition, FACS or other fluorescence-based methods can be used to select cells expressing hTRT to provide homogeneous populations for drug screening, particularly when transient transfection of cells is employed.

In other applications, regions of the hTRT can be mutagenized to identify regions (e.g., residues 193-196 (PRRR; SEQ ID NO:541) and 235-240 (PKRPRR; SEQ ID NO:542)) required for nuclear localization, which are targets for anti-telomerase drugs (telomerase activity modulators). Other applications include:

use of the fusion protein as a fluorescent marker of efficient cell transfection for both transient transfection experiments and when establishing stable cell lines expressing EGFP-hTRT;

expression of an hTRT-EGFP fusion with mutated nuclear localization signals (deficient for nuclear localization) in immortal cells so that the hTRT mutant-EGFP scavenges all the hTR of the immortal cells, retaining it in the cytoplasm and preventing telomere maintenance; and use as a tagged protein for immunoprecipitation.

Example 16

Effect of Mutation on Telomerase Catalytic Activity

This example describes hTRT variant proteins having altered amino acids and altered telomerase catalytic activity.

Amino acid substitutions followed by functional analysis is a standard means of assessing the importance and function of a polypeptide sequence. This example demonstrates that changes in the reverse transcriptase (RT) and telomerase (T) motifs affect telomerase catalytic activity.

Conventional nomenclature is used to describe mutants: the target residue in the native molecule (hTRT) is identified by one-letter code and position, and the corresponding residue in the mutant protein is indicated by one-letter code. Thus, for example, "K626A" specifies a mutant in which the lysine at position 626 (i.e., in motif 1) of hTRT is changed to an alanine.

A. Mutation of hTRT FFYxTE (SEQ ID NO:360) Motif

In initial experiments, a vector encoding an hTRT mutant protein, "F560A," was produced in which amino acid 560 of hTRT was changed from phenylalanine (F) to alanine (A) by site directed mutagenesis of pGRN121 using standard techniques. This mutation disrupts the TRT FFYxTE (SEQ ID NO:360) motif. The resulting F560A mutant polynucleotide was shown to direct synthesis of a full length hTRT protein as assessed using a cell-free reticulocyte lysate transcription/translation system in the presence of $^{35}$S-methionine.

When the mutant polypeptide was co-translated with hTR, as described in Example 7, no telomerase activity was detected as observed by TRAP using 20 cycles of PCR, while a control hTRT/hTR cotranslation did reconstitute activity. With 30 cycles of PCR in the TRAP assay, telomerase activity was observable with the mutant hTRT, but was considerably lower than the control (wild-type) hTRT.

B. Additional Site-Directed Mutagenesis of hTRT Amino Acid Residues

Conserved amino acids in six RT motifs were changed to alanine using standard site directed mutagenesis techniques (see, e.g., Ausubel, supra) to assess their contribution to catalytic activity. The mutants were assayed using IVR telomerase using the two step conventional/TRAP assay detailed in example 7.

The K626A (motif 1), R631A (motif 2), D712A (motif A), Y717A (motif A), D868A (motif C) mutants had greatly reduced or undetectable telomerase activity (<1% of wild-type), while the Q833A (motif B) and G932A (motif E) mutants exhibited low/intermediate levels of activity (<10% of wild-type). Two mutations outside the RT motifs, R688A and D897A, had activity equivalent to wild type hTRT. These results were consistent with analogous mutations in reverse transcriptases (Joyce et al., 1994, *Ann. Rev. Biochem.* 63:777) and are similar to results obtained with Est2p (see Lingner, 1997, *Science* 276:561). The experiments identify residues in the RT motifs critical and not critical for enzymatic activity and demonstrate that hTRT is the catalytic protein of human telomerase. The mutations provide variant hTRT polypeptides that have utility, e.g., as dominant/negative regulators of telomerase activity.

Amino acid alignment of the known TRTs identified a telomerase-specific motif, motif T (see supra). To determine the catalytic role of this motif in hTRT, a six amino acid deletion in this motif (Δ560-565; FFYxTE; SEQ ID NO:360), was constructed using standard site directed mutagenesis techniques (Ausubel, supra). The deletion was assayed using IVR telomerase using the two step conventional/TRAP assay detailed in Example 7. The Δ560-565 mutant had no observable telomerase activity after 25 cycles of PCR whereas wild type hTRT IVR telomerase produced a strong signal. Each amino acid in each residue in motif T was examined independently in a similar manner; mutants F560A, Y562A, T564A, and E565A retained intermediate levels of telomerase activity, while a control mutant, F487A, had minimal affect on activity. Notably, mutant F561A had greatly reduced or undetectable telomerase activity, while activity was fully restored in its "revertant", F561A561F. F561A561Fchanges the mutated position back to its original phenylalanine. This is a control that demonstrates that no other amino acid changes occurred to the plasmid that could account for the decreased activity observed. Thus, the T motif is the first non-RT motif shown to be absolutely required for telomerase activity.

Motif T can be used for identification of TRTs from other organisms and hTRT proteins comprising variants of this motif can be used as a dominant/negative regulator of telomerase activity. Unlike most other RTs, telomerase stably associates with and processively copies a small portion of a single RNA (ie. hTR), thus motif T can be involved in mediating hTR binding, the processivity of the reaction, or other functions unique to the telomerase RT.

In other experiments, it was observed that the deletion variant encoded by pro90hTRT described herein, did not reconstitute telomerase activity when co-synthesized with hTR, as measured using a modified TRAP assay (Autexier et al., 1996, *EMBO Journal* 15:5928, which is incorporated herein by reference).

Example 17

Screening for Telomerase Activity Modulators Using Recombinantly Expressed Telomerase Components This example describes the use of in vitro reconstituted telomerase for screening and identifying telomerase activity modulators. The assay described is easily adapted to high-through-put methods (e.g., using multiple well plates and/or robotic systems). Numerous variations on the steps of the assay will be apparent to one of skill in the art after review of this disclosure.

Recombinant clones for telomerase components (e.g., hTRT and hTR) are transcribed and translated (hTRT only) in an in vitro reaction as follows and as described in Example 7 supra, using the TNT7 T7 Coupled Reticulocyte lysate system (Promega), which is described in U.S. Pat. No. 5,324,637, following the manufacturer's instructions:

| Reagent | Amount per reaction (μL) |
|---|---|
| TNT Rabbit Reticulocyte lysate | 25 |
| TNT reaction buffer | 2 |
| TNT T7 RNA Pol. | 1 |
| AA mixture (complete) | 1 |
| Prime RNase inhibitor | 1 |
| Nuclease-free water | 16 |
| XbaI cut pGRN121 [hTRT] (0.5 μg) | 2 |
| FspI cut pGRN164 [hTR] (0.5 μg) | 2 |

The reaction is incubated at 30° C. for 2 hours. The product is then purified on an ultrafree-MC DEAE filter (Millipore).

The recombinant telomerase product (IVRP) is assayed in the presence and absence of multiple concentrations of test compounds which are solubilized in DMSO (e.g. 10 μM-100 μM). Test compounds are preincubated in a total volume of 25 μL IVRP, 2.5% DMSO, and 1×TRAP Buffer (20 mM Tris-HCl, pH 8.3, 1.5 mM MgCl$_2$, 63 mM KCl, 0.05% Tween20, 1.0 mM EGTA, 0.1 mg/ml Bovine serum albumin). Following the preincubation, 25 μL of the TRAP assay reaction mixture is added to each sample. The TRAP assay reaction mixture is composed of 1×TRAP buffer, 50 μL dNTP, 2.0 μg/ml primer ACX, 4 μg/ml primer U2, 0.8 attomol/ml TSU2, 2 units/50 μl Taq polymerase (Perkin Elmer), and 2 μg/ml [$^{32}$P]5'end-labeled primer TS (3000 Ci/mmol). The reaction tubes are then placed in the PCR thermocycler (MJ Research) and PCR is performed as follows: 60 min at 30° C., 20 cycles of {30 sec at 94° C., 30 sec. at 60° C., 30 sec. at 72° C.}, 1 min at 72° C., cool down to 10° C. The TRAP assay is described, as noted supra, in U.S. Pat. No. 5,629,154. The primers and substrate used have the sequences: TS Primer (5'-AATCCGTCGAGCAGAGTT-3'; SEQ ID NO:629); ACX Primer (5'-GCGCGG[CTTACC]$_3$CTAACC-3'; SEQ ID NO:630); U2 primer (5'-ATCGCTTCTCGGCCTTTT-3'; SEQ ID NO:631); TSU2 (5'-AATCCGTCGAGCAGAGTTAAAAGGCCGAGAAGCGAT-3'; SEQ ID NO:632)

After completion of the PCR step, 4 μl of 10× loading buffer containing bromophenol blue is added to each reaction tube and products (20 μl) are run on a 12.5% non-denaturing PAGE in 0.5×TBE at 400 V. The completed gel is subsequently dried and the TRAP products are visualized by Phosphorimager or by autoradiography. The telomerase activity in the presence of the test compound is measured by comparing the incorporation of label in reaction product to a parallel reaction lacking the agent.

The following clones described in the Examples have been deposited with the American Type Culture Collection, Rockville, Md. 20852, USA:

| | |
|---|---|
| Lambda phage λ25-1.1 | ATCC accession number 209024 |
| pGRN121 | ATCC accession number 209016 |
| Lambda phage λGΦ5 | ATCC accession number 98505 |

The present invention provides novel methods and materials relating to hTRT and diagnosis and treatment of telomerase-related diseases. While specific examples have been provided, the above description is illustrative and not restrictive. Many variations of the invention will become apparent to those of skill in the art upon review of this specification. The scope of the invention should, therefore, be determined not with reference to the above description, but instead should be determined with reference to the appended claims along with their full scope of equivalents.

SEQUENCE LISTING (727 sequences)

SEQ ID NO: 1 - DNA (cDNA), 4015 bp; single-stranded, linear
  CDS 56..3454: /product= "hTRT" /note= "human telomerase reverse transcriptase (hTRT) catalytic protein component"
gcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 2 - protein, 1132 aa
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 3 - DNA (cDNA), 2176 bp; single-stranded, linear
  - 1..2176: /note= "clone 712562"
  CDS 23..802
ggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccntctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcctgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgnaaaaaaaaaaaaaaaaaaaaaaaaaa

SEQ ID NO: 4 - DNA (cDNA), 3855 bp; single-stranded, linear
  - 1..3855: /note= "nucleic acid sequence with an open reading frame encoding a delta-182 variant polypeptide"
  CDS 56..2479: /product= "delta-182 variant polypeptide"
gcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaaaaaaaaaaaaa

SEQ ID NO: 5 - protein, 807 aa
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 6 - DNA (genomic), 4335 bp; single-stranded, linear
  - 1..4335: /note= "genomic DNA insert of pGRN144"
  intron 2715..2818: /note= "intron 1"
  intron 4173..4326: /note= "intron 2"
ccatgggacccactgcaggggcagctgggaggctgcaggcttcaggtcccagtggggttgccatctgccagtagaaacctgatgtagaatcagggcgcgagtgtggacactgtcctgaatctcaatgtctcagtgtgtgctgaaacatgtagaaattaaagtccatccctcctactctactgggattgagccccttccctatccccccccaggggcagaggagttcctctcactcctgtggaggaaggaatgatactttgttatttttcactgctggtactgaatccactgtttcatttgttggtttgtttgttttgttttgagaggcggtttcactcttgttgctcaggctggagggagtgcaatggcgcgatcttggcttactgcagcctctgcctcccaggttcaagtgattctcctgcttccgcctcccatttggctgggattacaggcacccgccaccatgcccagctaattttttgtatttttagtagagacgggggtgggggtggggttcaccatgttggccaggctggtctcgaacttctgacctcagatgatccacctgcctctgcctcctaaagtgctgggattacaggtgtgagccaccatgcccagctcagaatttactctgtttagaaacatctgggtctgaggtaggaagctcaccccactcaagtgttgtggtgttttaagccaatgatagaatttttttattgttgttagaacactcttgatgttttacactgtgatgactaagacatcatcagcttttcaaagacacactaactgcacccataatactggggtgtcttctgggtatcagcgatcttcattgaatgccgggaggcgtttcctcgccatgcacatggtgttaattactccagcataatcttctgcttccatttcttctcttccctcttttaaaattgtgttttctatgttggcttctctgcagagaaccagtgtaagctacaacttaacttttgttggaacaaattttccaaaccgcccctttgccctagtggcagagacaattcacaaacacagccctttaaaaaggcttagggatcactaaggggatttctagaagagcgacccgtaatccttaagtatttacaagacgaggctaacctccagcgagcgtgacagcccagggagggtgcgaggcctgttcaaatgctaagcttccataaataaagcaaatttcctccggcagtttctggaaagtaggaaaggttaacatttaaggttgcgtttgttagcatttcagtgtttgccgacctcagctaacagcatccctgcaaggcctcgggagacccagaagtttctcgccccttagatccaaacttgagcaacccggagtctggattcctgggaagtcctcagctgtcctgcggttgtgccggggccccaggtctggaggggaccagtggccgtgtggcttctactgctgggctggaagtcgggcctcctagctctgcagtccgaggcttggagccaggtgcctggaccccgaggctgccctccaccctgtgcgggcgggatgtgaccagatgttggcctcatctgccagacagagtgccggggcccagggtcaaggccgttgtggctggtgtgaggcgcccggtgcgcggccagcaggagcgcctggctccatttcccaccctttctcgacgggaccgccccggtgggtgattaacagatattggggtggtttgctcatggtggggaccccttcgccgcctgagaacctgcaaagagaaatgacgggcctgtgtcaaggagcccaagtcgcggggaagtgttgcagggaggcactccgggaggtcccgcgtgcccgtccagggagcaatgcgtcctcgggttcgtccccagccgcgtctacgcgcctccgtcctccccttcacgtccggcattcgtggtgcccggagcccgacgccccgcgtccggacctggaggcagccctgggtctccggatcaggccagcggccaaagggtcgccgcacgcacctgttcccagggcctccacatcatggcccctccctcgggttaccccacagcctaggccgattcgacctctctccgctggggccctcgctggcgtccctgcaccctgggagcgcgagcggcgcgcgggcggggaagcgcggcccagacccccgggtccgcccggagcagctgcgctgtcggggccaggccgggctcccagtggattcgcgggcaacagacgcccaggaccgcgcttcccacgtggcggagggactggggacccgggcaccggtcctgccccttcaccttccagctccgcctcgtccgcgcggaaccccgccccgtcccgaacccttcccgggtccccggcccagccccttccgggccatcccagcccgtcccgttccttttccgcggccccgccctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggtgaggaggtggtggccgtcgagggcccaggccccagagctgaatgcagtaggggctcagaaaagggggcaggcagagccctggtcctcctgtctccatcgtcacgtgggcacacgtggcttttcgctcaggacgtcgagtggacacggtgatcgaggtcgac

SEQ ID NO: 7 - DNA (genomic), 240 bp; single-stranded, linear
  intron 95..198: /note= "intron 1"
ggacccggcggctttccgcgcgctggtggcccagtgcctggtgtgcgtgccctgggacgcacggccgccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcagagg

SEQ ID NO: 8 - DNA (genomic), 389 bp; single-stranded, linear
  - 1..389: /note= "expressed sequence tag (EST) AA281296"
gccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggacgtgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcg

SEQ ID NO: 9 - DNA (genomic), 182 bp; single-stranded, linear
  - 1..182: /note= "182 basepair sequence deleted in clone 712562"
tctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtc

SEQ ID NO: 10 - protein, 259 aa [sequence omitted]

SEQ ID NO: 11 - protein, 34 aa
  Modified-site 2: /product= "OTHER" /note= "Xaa = Leu or Ile"
  Modified-site 10: /product= "OTHER" /note= "Xaa = Leu or Ile"
  Modified-site 11: /product= "OTHER" /note= "Xaa = Leu or Ile"
  Modified-site 12: /product= "OTHER" /note= "Xaa = Gln or Arg"
  Modified-site 28: /product= "OTHER" /note= "Xaa = Phe or Tyr"
  Modified-site 29: /product= "OTHER" /note= "Xaa = Phe or Tyr"
  Modified-site 31: /product= "OTHER" /note= "Xaa = Lys or His"
WXXXXXXXXXXXXFFWXTEXXXXXXXXXXRXXXW

SEQ ID NO: 12 - protein, 35 aa
  Modified-site 2: /product= "OTHER" /note= "Xaa = Leu or Ile"
  Modified-site 10: /product= "OTHER" /note= "Xaa = Leu or Ile"
  Modified-site 11: /product= "OTHER" /note= "Xaa = Leu or Ile"
  Modified-site 12: /product= "OTHER" /note= "Xaa = Gln or Arg"
  Modified-site 29: /product= "OTHER" /note= "Xaa = Phe or Tyr"
  Modified-site 30: /product= "OTHER" /note= "Xaa = Phe or Tyr"
  Modified-site 32: /product= "OTHER" /note= "Xaa = Lys or His"
WXXXXXXXXXXXXFFWXTEXXXXXXXXXXXRXXXW

SEQ ID NO: 13 - protein, 129 aa
  Peptide 1..129: /note= "TRT motifs from human"
AKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERA

SEQ ID NO: 14 - protein, 233 aa
  Peptide 1..233: /note= "TRT motifs from Schizosaccharomyces pombe tez1"
ISEIEWLVLGKRSNAKMCLSDFEKRKQIFAEFIYWLYNSFIIPILQSFFYITESSDLRNRTVYFRKDIWKLLCRPFITSMKMEAFEKINENNVRMDTQKTTLPPAVIRLLPKKNTFRLITNLRKRFLIKMGSNKKMLVSTNQTLRPVASILKHLINEESSGIPFNLEVYMKLLTFKKDLLKHRMFGRKKYFVRIDIKSCYDRIKQDLMFRIVKKKLKDPEFVIRKYATIHATS

SEQ ID NO: 15 - protein, 233 aa
  Peptide 1..233: /note= "TRT motifs from Saccharomyces cerevisiae EST2"
LKDFRWLFISDIWFTKHNFENLNQLAICFISWLFRQLIPKIIQTFFYCTEISSTVTIVYFRHDTWNKLITPFIVEYFKTYLVENNVCRNHNSYTLSNFNHSKMRIIPKKSNNEFRIIAIPCRGADEEEFTIYKENHKNAIQPTQKILEYLRNKRPTSFTKIYSPTQIADRIKEFKQRLLKKFNNVLPELYFMKFDVKSCYDSIPRMECMRILKDALKNENGFFVRSQYFFNTN

SEQ ID NO: 16 - protein, 233 aa
  Peptide 1..233: /note= "TRT motifs from Euplotes aediculatus p123"
TREISWMQVETSAKHFYYFDHENIYVLWKLLRWIFEDLVVSLIRCFFYVTEQQKSYSKTYYYRKNIWDVIMKMSIADLKKETLAEVQEKEVEEWKKSLGFAPGKLRLIPKKTTFRPIMTFNKKIVNSDRKTTKLTTNTKLLNSHLMLKTLKNRMFKDPFGFAVFNYDDVMKKYEEFVCKWKQVGQPKLFFATMDIEKCYDSVNREKLSTFLKTTKLLSSDFWIMTAQILKRKN

SEQ ID NO: 17 - protein, 4 aa
  Peptide 1..4: /note= "consensus telomerase RT sequence from motif T"
  Modified-site 1: /product= "OTHER" /note= "Xaa = polar amino acid, Gly, Ser, Thr, Tyr, Cys, Asn or Gln"
XFFY

SEQ ID NO: 18 - protein, 7 aa
  Peptide 1..7: /note= "consensus telomerase RT sequence from motif 1"
  Modified-site 1: /product= "OTHER" /note= "Xaa = hydrophobic amino acid, Ala, Leu, Ile, Val, Pro, Phe, Trp or Met"
  Modified-site 3: /product= "OTHER" /note= "Xaa = hydrophobic amino acid, Ala, Leu, Ile, Val, Pro, Phe, Trp or Met"
XRXIPKK

SEQ ID NO: 19 - protein, 4 aa
  Peptide 1..4: /note= "consensus telomerase RT sequence from motif 2"
  Modified-site 3: /product= "OTHER" /note= "Xaa = hydrophobic amino acid, Ala, Leu, Ile, Val, Pro, Phe, Trp or Met"
FRXI

SEQ ID NO: 20 - protein, 6 aa
  Peptide 1..6: /note= "consensus telomerase RT sequence from motif A"
  Modified-site 2: /product= "OTHER" /note= "Xaa = charged amino acid, Asp, Glu, His, Lys or Arg"
  Modified-site 6: /product= "OTHER" /note= "Xaa = hydrophobic amino acid, Ala, Leu, Ile, Val, Pro, Phe, Trp or Met"
PXLYFX

SEQ ID NO: 21 - protein, 6 aa
  Peptide 1..6: /note= "consensus telomerase RT sequence from motif B'"
GIPQGS

SEQ ID NO: 22 - protein, 4 aa
  Peptide 1..4: /note= "consensus telomerase RT sequence from motif C"
LLRL

SEQ ID NO: 23 - protein, 7 aa
  Peptide 1..7: /note= "consensus telomerase RT sequence from motif C"
  Modified-site 5: /product= "OTHER" /note= "Xaa = hydrophobic amino acid, Ala, Leu, Ile, Val, Pro, Phe, Trp or Met"
DDFLXIT

SEQ ID NO: 24 - protein, 48 aa
  Peptide 1..48: /note= "motif T peptide from Schizosaccharomyces pombe TRT tez1p"
WLYNSFIIPILQSFFYITESSDLRNRTVYFRKDIWKLLCRPFITSMKM

SEQ ID NO: 25 - protein, 54 aa
  Peptide 1..54: /note= "motif 1 and 2 peptide from Schizosaccharomyces pombe TRT tez1p"
NNVRMDTQKTTLPPAVIRLLPKKNTFRLITNLRKRFLIKMGSNKKMLVSTNQTL

SEQ ID NO: 26 - protein, 34 aa
  Peptide 1..34: /note= "motif A peptide from Schizosaccharomyces pombe TRT tez1p"
FGRKKYFVRIDIKSCYDRIKQDLMFRIVKKKLKD

SEQ ID NO: 27 - protein, 35 aa
  Peptide 1..35: /note= "motif B' peptide from Schizosaccharomyces pombe TRT tez1p"
SQYLQKVGIPQGSILSSFLCHFYMEDLIDEYLSFT

SEQ ID NO: 28 - protein, 43 aa
  Peptide 1..43: /note= "motif C and D peptide from Schizosaccharomyces pombe TRT tez1p"
LLRVVDDFLFITVNKKDAKKFLNLSLRGFEKHNFSTSLEKTVI

SEQ ID NO: 29 - protein, 11 aa
  Peptide 1..11: /note= "motif E peptide from Schizosaccharomyces pombe TRT tez1p"
KKRMPFFGFSV

SEQ ID NO: 30 - protein, 48 aa
  Peptide 1..48: /note= "motif T peptide from human TRT"
WLMSVYVVELLRSFFYVTETTFQKNRLFFYRKSVWSKLQSIGIRQHLK

SEQ ID NO: 31 - protein, 54 aa
  Peptide 1..54: /note= "motif 1 and 2 peptide from human TRT"
EVRQHREARPALLTSRLRFIPKPDGLRPIVNMDYVVGARTFRREKRAERLTSRV

SEQ ID NO: 32 - protein, 34 aa
  Peptide 1..34: /note= "motif A peptide from human TRT"
PPPELYFVKVDVTGAYDTIPQDRLTEVIASIIKP

SEQ ID NO: 33 - protein, 35 aa
  Peptide 1..35: /note= "motif B' peptide from human TRT"
KSYVQCQGIPQGSILSTLLCSLCYGDMENKLFAGI

SEQ ID NO: 34 - protein, 43 aa
  Peptide 1..43: /note= "motif C and D peptide from human TRT"
LLRLVDDFLLVTPHLTHAKTFLRTLVRGVPEYGCVVNLRKTVV

SEQ ID NO: 35 - protein, 11 aa
  Peptide 1..11: /note= "motif E peptide from human TRT"
HGLFPWCGLLL

SEQ ID NO: 36 - protein, 48 aa
  Peptide 1..48: /note= "motif T peptide from Euplotes aediculatus p123"
WIFEDLVVSLIRCFFYVTEQQKSYSKTYYYRKNIWDVIMKMSIADLKK

SEQ ID NO: 37 - protein, 54 aa
  Peptide 1..54: /note= "motif 1 and 2 peptide from Euplotes aediculatus p123"
KEVEEWKKSLGFAPGKLRLIPKKTTFRPIMTFNKKIVNSDRKTTKLTTNTKLLN

SEQ ID NO: 38 - protein, 34 aa
  Peptide 1..34: /note= "motif A peptide from Euplotes aediculatus p123"
GQPKLFFATMDIEKCYDSVNREKLSTFLKTTKLL

SEQ ID NO: 39 - protein, 35 aa
  Peptide 1..35: /note= "motif B' peptide from Euplotes aediculatus p123"
KFYKQTKGIPQGLCVSSILSSFYYATLEESSLGFL

SEQ ID NO: 40 - protein, 43 aa
  Peptide 1..43: /note= "motif C and D peptide from Euplotes aediculatus p123"
LMRLTDDYLLITTQENNAVLFIEKLINVSRENGFKFNMKKLQT

SEQ ID NO: 41 - protein, 11 aa
  Peptide 1..11: /note= "motif E peptide from Euplotes aediculatus p123"
QDYCDWIGISI

SEQ ID NO: 42 - protein, 47 aa
  Peptide 1..47: /note= "motif T peptide from Saccharomyces cerevisiae EST2p"
WLFRQLIPKIIQTFFYCTEISSTVTIVYFRHDTWNKLITPFIVEYFK

SEQ ID NO: 43 - protein, 26 aa
  Peptide 1..26: /note= "motif 1 peptide from Saccharomyces cerevisiae EST2p"
CRNHNSYTLSNFNHSKMRIIPKKSNN

SEQ ID NO: 44 - protein, 29 aa
  Peptide 1..29: /note= "motif 2 peptide from Saccharomyces cerevisiae EST2p"
FRIIAIPCRGADEEEFTIYKENHKNAIQP

SEQ ID NO: 45 - protein, 34 aa
  Peptide 1..34: /note= "motif A peptide from Saccharomyces cerevisiae EST2p"
VLPELYFMKFDVKSCYDSIPRMECMRILKDALKN

SEQ ID NO: 46 - protein, 35 aa
  Peptide 1..35: /note= "motif B' peptide from Saccharomyces cerevisiae EST2p"
KCYIREDGLFQGSSLSAPIVDLVYDDLLEFYSEFK

SEQ ID NO: 47 - protein, 43 aa
  Peptide 1..43: /note= "motif C and D peptide from Saccharomyces cerevisiae EST2p"
ILKLADDFLIISTDQQQVINIKKLAMGGFQKYNAKANRDKILA

SEQ ID NO: 48 - protein, 11 aa
  Peptide 1..11: /note= "motif E peptide from Saccharomyces cerevisiae EST2p"
KELEVWKHSST

SEQ ID NO: 49 - protein, 4 aa
  Peptide 1..4: /note= "consensus non-telomerase RT sequence from motif B'"
  Modified-site 1: /product= "OTHER" /note= "Xaa = hydrophobic amino acid, Ala, Leu, Ile, Val, Pro, Phe, Trp or Met"
XPQG

SEQ ID NO: 50 - protein, 5 aa
  Peptide 1..5: /note= "consensus non-telomerase RT sequence from motif C"
  Modified-site 3: /product= "OTHER" /note= "Xaa = hydrophobic amino acid, Ala, Leu, Ile, Val, Pro, Phe, Trp or Met"
  Modified-site 4: /product= "OTHER" /note= "Xaa = hydrophobic amino acid, Ala, Leu, Ile, Val, Pro, Phe, Trp or Met"
  Modified-site 5: /product= "OTHER" /note= "Xaa = hydrophobic amino acid, Ala, Leu, Ile, Val, Pro, Phe, Trp or Met"
DDXXX

SEQ ID NO: 51 - protein, 55 aa
  Peptide 1..55: /note= "motif 1 and 2 peptide from Saccharomyces cerevisiae cytochrome oxidase group II intron 1-encoded mitochondrial protein"
LSNELGTGKFKFKPMRIVNIPKPKGGIRPLSVGNPRDKIVQEVMRMILDTIFDKK

SEQ ID NO: 52 - protein, 34 aa
  Peptide 1..34: /note= "motif A peptide from Saccharomyces cerevisiae cytochrome oxidase group II intron 1-encoded mitochondrial protein"
FGGSNWFIEVDLKKCFDTISHDLIIKELKRYISD

SEQ ID NO: 53 - protein, 35 aa
  Peptide 1..35: /note= "motif B' peptide from Saccharomyces cerevisiae cytochrome oxidase group II intron 1-encoded mitochondrial protein"
TYHKPMLGLPQGSLISPILCNIVMTLVDNWLEDYI

SEQ ID NO: 54 - protein, 17 aa
  Peptide 1..17: /note= "motif C peptide from Saccharomyces cerevisiae cytochrome oxidase group II intron 1-encoded mitochondrial protein"
YVRYADDILIGVLGSKN

SEQ ID NO: 55 - protein, 25 aa
  Peptide 1..25: /note= "motif D peptide from Saccharomyces cerevisiae cytochrome oxidase group II intron 1-encoded mitochondrial protein"
KMIKRDLNNFLNSLGLTINEEKTLI

SEQ ID NO: 56 - protein, 11 aa
  Peptide 1..11: /note= "motif E peptide from Saccharomyces cerevisiae cytochrome oxidase group II intron 1-encoded mitochondrial protein"
ETPARFLGYNI

SEQ ID NO: 57 - protein, 26 aa
  Peptide 1..26: /note= "motif 1 peptide from Drosophila melanogaster TART non-LTR retrotransposable element reverse transcriptase"
SILRIGYYPDAWKHAQVKMILKPGKS

SEQ ID NO: 58 - protein, 29 aa
  Peptide 1..29: /note= "motif 2 peptide from Drosophila melanogaster TART non-LTR retrotransposable element reverse transcriptase"
YRPISLLSGLSKMFERLLLKRLFRVDLFK

SEQ ID NO: 59 - protein, 34 aa
  Peptide 1..34: /note= "motif A peptide from Drosophila melanogaster TART non-LTR retrotransposable element reverse transcriptase"
RKEYCSAVFLDISEAFDRVWHEGLLLKLAKILPY

SEQ ID NO: 60 - protein, 35 aa
  Peptide 1..35: /note= "motif B' peptide from Drosophila melanogaster TART non-LTR retrotransposable element reverse transcriptase"
RAGQIGAGVPQGSNLGPILYSIFSSDMPLPHIYHP

SEQ ID NO: 61 - protein, 17 aa
  Peptide 1..17: /note= "motif C peptide from Drosophila melanogaster TART non-LTR retrotransposable element reverse transcriptase"
LSTYADDTIVLSSDILA

SEQ ID NO: 62 - protein, 26 aa
  Peptide 1..26: /note= "motif D peptide from Drosophila melanogaster TART non-LTR retrotransposable element reverse transcriptase"
NENYLKTFSDWADKWGISVNAAKTGH

SEQ ID NO: 63 - protein, 11 aa
  Peptide 1..11: /note= "motif E peptide from Drosophila melanogaster TART non-LTR retrotransposable element reverse transcriptase"
ESKQSYLGVIL

SEQ ID NO: 64 - protein, 26 aa
  Peptide 1..26: /note= "motif 1 peptide from HIV-1 reverse transcriptase"
EGKISKIGPENPYNTPVFAIKKKDST

SEQ ID NO: 65 - protein, 63 aa
  Peptide 1..63: /note= "motif 2 and A peptide from HIV-1 reverse transcriptase"
WRKLVDFRELNKRTQDFWEVQLGIPHPAGLKKKKSVTVLDVGDAYFSVPLDEDFRKYTAFTIP

SEQ ID NO: 66 - protein, 35 aa
  Peptide 35: /note= "motif B' peptide from HIV-1 reverse transcriptase"
GIRYQYNVLPQGWKGSPAIFQSSMTKILEPFKKQN

SEQ ID NO: 67 - protein, 17 aa
  Peptide 1..17: /note= "motif C peptide from HIV-1 reverse transcriptase"
IYQYMDDLYVGSDLEIG

SEQ ID NO: 68 - protein, 37 aa
  Peptide 1..37: /note= "motif D and E peptide from HIV-1 reverse transcriptase"
HRTKIEELRQHLLRWGLTTPDKKHQKEPPFLWMGITL

SEQ ID NO: 69 - protein, 4 aa
  Peptide 1..4: /note= "consensus telomerase RT finger sequence from motif 1"
IPKK

SEQ ID NO: 70 - protein, 5 aa
  Peptide 1..5: /note= "consensus telomerase RT palm, primer grip sequence from motif C"
LLLRL

SEQ ID NO: 71 - protein, 4 aa
  Peptide 1..4: /note= "consensus telomerase RT palm, primer grip sequence from motif C"
DDFL

SEQ ID NO: 72 - protein, 43 aa
  Peptide 1..43: /note= "telomerase specific motif T peptide from human TRT"
WLMSVYVVELLRSFFYVTETTFQKNRLFFYRKSVWSKLQSIGI

SEQ ID NO: 73 - protein, 5 aa
  Peptide 1..5: /note= "telomerase specific motif T' peptide from human TRT"
EAEVR

SEQ ID NO: 74 - protein, 16 aa
  Peptide 1..16: /note= "telomerase RT finger motif 1 and 2 peptide from human TRT"
SRLRFIPKPDGLRPIV

SEQ ID NO: 75 - protein, 17 aa
  Peptide 1..17: /note= "telomerase RT finger motif A peptide from human TRT"
PELYFVKVDVTGAYDTI

SEQ ID NO: 76 - protein, 22 aa
  Peptide 1..22: /note= "telomerase RT finger motif B' peptide from human TRT"
YVQCQGIPQGSILSTLLCSLCY

SEQ ID NO: 77 - protein, 13 aa
  Peptide 1..13: /note= "telomerase RT palm, primer grip motif C peptide from human TRT"
LLLRLVDDFLLVT

SEQ ID NO: 78 - protein, 16 aa
  Peptide 1..16: /note= "telomerase RT palm, primer grip motif D peptide from human TRT"
GVPEYGCVVNLRKTVV

SEQ ID NO: 79 - protein, 11 aa
  Peptide 1..11: /note= "telomerase RT palm, primer grip motif E peptide from human TRT"
WCGLLLDTRTL

SEQ ID NO: 80 - protein, 43 aa
  Peptide 1..43: /note= "telomerase specific motif T peptide from Schizosaccharomyces pombe TRT"
WLYNSFIIPILQSFFYITESSDLRNRTVYFRKDIWKLLCRPFI

SEQ ID NO: 81 - protein, 5 aa
  Peptide 1..5: /note= "telomerase specific motif T' peptide from Schizosaccharomyces pombe TRT"
ENNVR

SEQ ID NO: 82 - protein, 16 aa
  Peptide 1..16: /note= "telomerase RT finger motif 1 and 2 peptide from Schizosaccharomyces pombe TRT"
AVIRLLPKKNTFRLIT

SEQ ID NO: 83 - protein, 17 aa
  Peptide 1..17: /note= "telomerase RT finger motif A peptide from Schizosaccharomyces pombe TRT"
RKKYFVRIDIKSCYDRI

SEQ ID NO: 84 - protein, 22 aa
  Peptide 1..22: /note= "telomerase RT finger motif B' peptide from Schizosaccharomyces pombe TRT"
YLQKVGIPQGSILSSFLCHFYM

SEQ ID NO: 85 - protein, 13 aa
  Peptide 1..13: /note= "telomerase RT palm, primer grip motif C peptide from Schizosaccharomyces pombe TRT"
VLLRVVDDFLFIT

SEQ ID NO: 86 - protein, 16 aa
  Peptide 1..16: /note= "telomerase RT palm, primer grip motif D peptide from Schizosaccharomyces pombe TRT"
GFEKHNFSTSLEKTVI

SEQ ID NO: 87 - protein, 11 aa
  Peptide 1..11: /note= "telomerase RT palm, primer grip motif E peptide from Schizosaccharomyces pombe TRT"
FFGFSVNMRSL

SEQ ID NO: 88 - protein, 43 aa
  Peptide 1..43: /note= "telomerase specific motif T peptide from Euplotes aediculatus p123"
WIFEDLVVSLIRCFFYVTEQQKSYSKTYYYRKNIWDVIMKMSI

SEQ ID NO: 89 - protein, 5 aa
  Peptide 1..5: /note= "telomerase specific motif T' peptide from Euplotes aediculatus p123"
EKEVE

SEQ ID NO: 90 - protein, 16 aa
  Peptide 1..16: /note= "telomerase RT finger motif 1 and 2 peptide from Euplotes aediculatus p123"
GKLRLIPKKTTFRPIM

SEQ ID NO: 91 - protein, 17 aa
  Peptide 1..17: /note= "telomerase RT finger motif A peptide from Euplotes aediculatus p123"
PKLFFATMDIEKCYDSV

SEQ ID NO: 92 - protein, 22 aa
  Peptide 1..22: /note= "telomerase RT finger motif B' peptide from Euplotes aediculatus p123"
YKQTKGIPQGLCVSSILSSFYY

SEQ ID NO: 93 - protein, 13 aa
  Peptide 1..13: /note= "telomerase RT palm, primer grip motif C peptide from Euplotes aediculatus p123"
LLMRLTDDYLLIT

SEQ ID NO: 94 - protein, 16 aa
  Peptide 1..16: /note= "telomerase RT palm, primer grip motif D peptide from Euplotes aediculatus p123"
VSRENGFKFNMKKLQT

SEQ ID NO: 95 - protein, 11 aa
  Peptide 1..11: /note= "telomerase RT palm, primer grip motif E peptide from Euplotes aediculatus p123"
WIGISIDMKTL

SEQ ID NO: 96 - protein, 42 aa
  Peptide 1..42: /note= "telomerase specific motif T peptide from Saccharomyces cerevisiae EST2"
WLFRQLIPKIIQTFFYCTEISSTVTIVYFRHDTWNKLITPFI

SEQ ID NO: 97 - protein, 5 aa
  Peptide 1..5: /note= "telomerase specific motif T' peptide from Saccharomyces cerevisiae EST2"
ENNVC

SEQ ID NO: 98 - protein, 11 aa
  Peptide 1..11: /note= "telomerase RT finger motif 1 peptide from Saccharomyces cerevisiae EST2"
SKMRIIPKKSN

SEQ ID NO: 99 - protein, 5 aa
  Peptide 1..5: /note= "telomerase RT finger motif 2 peptide from Saccharomyces cerevisiae EST2"
FRIIA

SEQ ID NO: 100 - protein, 17 aa
  Peptide 1..17: /note= "telomerase RT finger motif A peptide from Saccharomyces cerevisiae EST2"
PELYFMKFDVKSCYDSI

SEQ ID NO: 101 - protein, 22 aa
  Peptide 1..22: /note= "telomerase RT finger motif B' peptide from Saccharomyces cerevisiae EST2"
YIREDGLFQGSSLSAPIVDLVY

SEQ ID NO: 102 - protein, 13 aa
  Peptide 1..13: /note= "telomerase RT palm, primer grip motif C peptide from Saccharomyces cerevisiae EST2"
LILKLADDFLIIS

SEQ ID NO: 103 - protein, 16 aa
  Peptide 1..16: /note= "telomerase RT palm, primer grip motif D peptide from Saccharomyces cerevisiae EST2"
GFQKYNAKANRDKILA

SEQ ID NO: 104 - protein, 11 aa
  Peptide 1..11: /note= "telomerase RT palm, primer grip motif E peptide from Saccharomyces cerevisiae EST2"
WKHSSTMNNFH

SEQ ID NO: 105 - DNA, 10 bp; single-stranded, linear
  protein_bind 1..10: /note= "NFkappaB CS1 binding site motif"
gggrhtyyhc

SEQ ID NO: 106 - DNA, 11 bp; single-stranded, linear
  protein_bind 1..11: /note= "NFkappaB MHC I.2 binding site motif"
tgggcttcccc

SEQ ID NO: 107 - DNA, 11 bp; single-stranded, linear
  protein_bind 1..11: /note= "NFkappaB CS2 binding site motif"
rgggrmtyycc

SEQ ID NO: 108 - DNA, 18 bp; single-stranded, /note= "topoisomerase II cleavage site motif"
  protein_bind 1..18
rnynncnngyngktnyny

SEQ ID NO: 109 - DNA (genomic), 3279 bp; single-stranded, linear
  CDS 101..3196: /note= "Euplotes aediculatus 123 kDa telomerase protein subunit (TRT)" /codon= (seq: "tga", aa: Cys) /product= "Euplotes aediculatus 123 kDa telomerase protein subunit (TRT)"
aaaaccccaaaaccccaaaaccccttttagagccctgcagttggaaatataacctcagtattaataagctcagattttaaatattaattacaaaacctaaatggaggttgatgttgataatcaagctgataatcatggcattcactcagctcttaagacttgtgaagaaattaaagaagctaaaacgttgtactcttggatccagaaagttattagatgaagaaatcaatctcaaagtcattataaagatttagaagatattaaaatatttgcgcagacaaatattgttgctactccacgagactataatgaagaagattttaaagttattgcaagaaaagaagtattttcaactggactaatgatcgaacttattgacaaatgcttagttgaacttctttcatcaagcgatgtttcagatagacaaaaacttcaatgatttggatttcaacttaagggaaatcaattagcaaagacccatttattaacagctctttcaactcaaaagcagtatttctttcaagacgaatggaaccaagttagagcaatgattggaaatgagctcttccgacatctctacactaaatatttaatattccagcgaacttctgaaggaactcttgttcaattttgcgggaataacgtttttgatcatttgaaagtcaacgataagtttgacaaaaagcaaaaaggtggagcagcagacatgaatgaacctcgatgttgatcaacctgcaaatacaatgtcaagaatgagaaagatcactttctcaacaacatcaacgtgccgaattggaataatatgaaatcaagaaccagaatattttattgcactcattttaatagaaataaccaattcttcaaaaagcatgagtttgtgagtaacaaaaacaatatttcagcgatggacagagctcagacgatattcacgaatatattcagatttaatagaattagaaagaagctaaaagataaggttatcgaaaaaattgcctacatgcttgagaaagtcaaagattttaacttcaactactatttaacaaaatcttgtcctcttccagaaaattggcgggaacggaaacaaaaaatcgaaaacttgataaataaaactagagaagaaaagtcgaagtactatgaagagctgtttagctacacaactgataataaatgcgtcacacaatttattaatgaatttttctacaatatactccccaaagactttttgactggaagaaaccgtaagaattttcaaaagaaagttaagaaatatgtggaactaaacaagcatgaactcattcacaaaaacttattgcttgagaagatcaatacaagagaaatatcatggatgcaggttgagacctctgcaaagcatttttattattttgatcacgaaaacatctacgtcttatggaaattgctccgatggatattcgaggatctcgtcgtctcgctgattagatgatttttctatgtcaccgagcaacagaaaagttactccaaaacctattactacagaaagaatatttgggacgtcattatgaaaatgtcaatcgcagacttaaagaaggaaacgcttgctgaggtccaagaaaaagaggttgaagaatggaaaaagtcgcttggatttgcacctggaaaactcagactaataccgaagaaaactactttccgtccaattatgactttcaataagaagattgtaaattcagaccggaagactacaaaattaactacaaatacgaagttattgaactctcacttaatgcttaagacattgaagaatagaatgtttaaagatccttttggattcgctgtttttaactatgatgatgtaatgaaaaagtatgaggagtttgtttgcaaatggaagcaagttggacaaccaaaactcttctttgcaactatggatatcgaaaagtgatatgatagtgtaaacagagaaaaactatcaacattcctaaaaactactaaattactttcttcagatttctggattatgactgcacaaattctaaagagaaagaataacatagttatcgattcgaaaaactttagaaagaaagaaatgaaagattattttagacagaaattccagaagattgcacttgaaggaggacaatatccaaccttattcagtgttcttgaaaatgaacaaaatgacttaaatgcaaagaaaacattaattgttgaagcaaagcaaagaaattattttaagaaagataacttacttcaaccagtcattaatatttgccaatataattacattaactttaatgggaagttttataaacaaacaaaaggaattcctcaaggtctttgagtttcatcaattttgtcatcattttattatgcaacattagaggaaagctccttaggattccttagagatgaatcaatgaaccctgaaaatccaaatgttaatcttctaatgagacttacagatgactatcttttgattacaactcaagagaataatgcagtattgtttattgagaaacttataaacgtaagtcgtgaaaatggatttaaattcaatatgaagaaactacagactagttttccattaagtccaagcaaatttgcaaaatacggaatggatagtgttgaggagcaaaatattgttcaagattactgcgattggattggcatctcaattgatatgaaaactcttgctttaatgccaaatattaacttgagaatagaaggaattctgtgtacactcaatctaaacatgcaaacaaagaaagcatcaatgtggctcaagaagaaactaaagtcgtttttaatgaataacattacccattattttagaaagacgattacaaccgaagactttgcgaataaaactctcaacaagttatttatatcaggcggttacaaatacatgcaatgagccaaagaatacaaggaccactttaagaagaacttagctatgagcagtatgatcgacttagaggtatctaaaattatatactctgtaaccagagcattctttaaataccttgtgtgcaatattaaggatacaatttttggagaggagcattatccagactttttccttagcacactgaagcactttattgaaatattcagcacaaaaaagtacattttcaacagagtttgcatgatcctcaaggcaaaagaagcaaagctaaaaagtgaccaatgtcaatctctaattcaatatgatgcatagtcgactattctaacttattttggaaagttaattttcaatttttgtcttatatactggggttttggggttttggggttttgggg

SEQ ID NO: 110 - protein, 1031 aa
MEVDVDNQADNHGIHSALKTCEEIKEAKTLYSWIQKVIRCRNQSQSHYKDLEDIKIFAQTNIVATPRDYNEEDFKVIARKEVFSTGLMIELIDKCLVELLSSSDVSDRQKLQCFGFQLKGNQLAKTHLLTALSTQKQYFFQDEWNQVRAMIGNELFRHLYTKYLIFQRTSEGTLVQFCGNNVFDHLKVNDKFDKKQKGGAADMNEPRCCSTCKYNVKNEKDHFLNNINVPNWNNMKSRTRIFYCTHFNRNNQFFKKHEFVSNKNNISAMDRAQTIFTNIFRFNRIRKKLKDKVIEKIAYMLEKVKDFNFNYYLTKSCPLPENWRERKQKIENLINKTREEKSKYYEELFSYTTDNKCVTQFINEFFYNILPKDFLTGRNRKNFQKKVKKYVELNKHELIHKNLLLEKINTREISWMQVETSAKHFYYFDHENIYVLWKLLRWIFEDLVVSLIRCFFYVTEQQKSYSKTYYYRKNIWDVIMKMSIADLKKETLAEVQEKEVEEWKKSLGFAPGKLRLIPKKTTFRPIMTFNKKIVNSDRKTTKLTTNTKLLNSHLMLKTLKNRMFKDPFGFAVFNYDDVMKKYEEFVCKWKQVGQPKLFFATMDIEKCYDSVNREKLSTFLKTTKLLSSDFWIMTAQILKRKNNIVIDSKNFRKKEMKDYFRQKFQKIALEGGQYPTLFSVLENEQNDLNAKKTLIVEAKQRNYFKKDNLLQPVINICQYNYINFNGKFYKQTKGIPQGLCVSSILSSFYYATLEESSLGFLRDESMNPENPNVNLLMRLTDDYLLITTQENNAVLFIEKLINVSRENGFKFNMKKLQTSFPLSPSKFAKYGMDSVEEQNIVQDYCDWIGISIDMKTLALMPNINLRIEGILCTLNLNMQTKKASMWLKKKLKSFLMNNITHYFRKTITTEDFANKTLNKLFISGGYKYMQCAKEYKDHFKKNLAMSSMIDLEVSKIIYSVTRAFFKYLVCNIKDTIFGEEHYPDFFLSTLKHFIEIFSTKKYIFNRVCMILKAKEAKLKSDQCQSLIQYDA

SEQ ID NO: 111 - DNA (genomic) 1595..1857, 1894..2286, 2326..2396, 2436..2705, 2746..2862, 2914..3083, 3125..3309, 3356..3504, 3546..3759, 3797..4046, 4086..4252, 4296..4392, 4435..4597), 5544 bp; single-stranded, linear
  CDS join(959..1216, 1273..1353, 1425..1543,: /note= "Schizosaccharomyces pombe telomerase catalytic subunit (TRT)"
ggtaccgatttactttcctttcttcataagctaattgcttcctcgaacgctcctaaatctctggaaatatttttacaagaactcaataacaataccaagtcaaattccaatatgaaggtgttattagtgatcgataatatttctattttatcggtcgttaccaagtataaggacaaaaagaacaacttccttccccctaaagacttttactttattaatttacttttcaaatatatttcgggttcgcttacttttaatcgtggtactgttttagctgctacttctagccaaccgcgtgtttctaccccgtcattggatatagctcttggagtagctcacagaaatccttacaaatcttctgatgagactatattagattcattacagtccgtgcatattcttaacatggagccttacactttagatgagtcacgtcgcatgatggagtatttggtatcatccaacgtttgccttgaaaaggttgataattatttgcaaaatcatgtccttagtggtggtaatccgcgaaagttttttgatgcttgcacacgtctagcatgattgagatattcaaaaatttctatccactacaactcctttaacgcggttttatttttctattttctattctcatgttgttccaaatatgtatcatctcgtattaggcttttttccgttttactcctggaatcgtacctttttcactattccccctaatgaataatctaaattagtttcgcttataattgatagtagtagaaagattggtgattctactcgtgtaatgttattagtttaaagatactttgcaaaacatttattagctatcattatataaaaaaaatcctataattataaatattaatcaatatttgcggtcactatttatttaaaacgttatgatcagtaggacactttgcatatatatagttatgcttaatggttacttgtaacttgcatgaccgaacaccatacccccaaaagcaggattcttcgctttctagagaatcaatatgtatacctatgtaccttaaatgattatgtacaacttgttttgagagggtcgccggcaagctcgtatagcaatatatgcgaacgcttgagaagcgatgtacaaacgtccttttctatttttcttcattcgactgtagtcggcttcgacagtaagccagatgaaggtgttcaattttcttctccaaaatgctcacagtcagaggtatatatatttttgttttgatttttttctattcgggatagctaatatatgggcagctaatagcgaatgttgtaaaacagatgttcgatgaaagttttgagcgtcgaaggaatctactgatgaaagggttttccatggtaaggtattctaattgtgaaatatttacctgcaattactgtttcaaagagattgtatttaaccgataaagaatcatgaagattttcgagccatgcatgtaaacggagtacaaaatgatctcgtttctacttttcctaattaccttatatctatacttgagtcaaaaaattggcaacttttgttagaaatgtaaataccggttaagatgttgcgcactttgaacaagactgacaagtatagtatcggcagtgatgccatgcattacttattatccaaaggaagtatttttgaggctcttccaaatgacaattaccttcagatttctggcataccactttttaaaaataatgtgtttgaggaaactgtgtcaaaaaaaagaaagcgaaccattgaaacatccattactcaaaataaaagcgcccgcaaagaagtttcctggaatagcatttcaattagtaggtttagcattttttacaggtcatcctataagaagtttaagcaaggtaactaatactgttatccttcataactaattttagatctatattttaacttacactctatttgtgatcggaacacagtacacatgtggcttcaatggatttttccaaggcaatttggacttataaacgcatttcaagtgaagcaattgcacaaagtgattccactggtatcacagagtacagttgtgcccaaacgtctcctaaaggtataccctttaattgaacaaacagcaaagcgactccatcgtatttctctatcaaaagtttacaaccattattgcccatatattgacacccacgatgatgaaaaaatccttagttattccttaaagccgaaccaggtgtttgcgtttcttcgatccattcttgttcgagtgtttcctaaattaatctggggtaaccaaaggatatttgagataatattaaaaggtattgtataaaatttattaccactaacgattttaccagacctcgaaactttcttgaaattatcgagatacgagtcttttagtttacattatttaatgagtaacataaaggtaatatgccaaatttttttaccattaattaacaatcagatttcagaaattgaatggctagtccttggaaaaaggtcaaatgcgaaaatgtgcttaagtgattttgagaaacgcaagcaaatatttgcggaattcatctactggctatacaattcgtttataatacctattttacaatcttttttttatatcactgaatcaagtgatttacgaaatcgaactgtttattttagaaaagatatttggaaactcttgtgccgaccctttattacatcaatgaaaatggaagcgtttgaaaaaataaacgaggtattttaaagtattttttgcaaaaagctaatattttcagaacaatgttaggatggatactcagaaaactactttgcctccagcagttattcgtctattacctaagaagaatacctttcgtctcattacgaatttaagaaaaagattcttaataaaggtattaatttttggtcatcaatgtactttacttctaatctattattagcagatgggttcaaacaaaaaaatgttagtcagtacgaaccaaactttacgacctgtggcatcgatactgaaacatttaatcaatgaagaaagtagtggtattccatttaacttggaggtttacatgaagcttcttacttttaagaaggatcttcttaagcaccgaatgtttgggtaattatataatgcgcgattcctcattattaattttgcaggcgtaagaagtattttgtacggatagatataaaatcctgttatgatcgaataaagcaagatttgatgtttcggattgttaaaaagaaactcaaggatcccgaatttgtaattcgaaagtatgcaaccatacatgcaacaagtgaccgagctacaaaaaactttgttagtgaggcgttttcctattgtaagtttattttttcattggaattttttaacaaattcttttttagttgatatggtgccttttgaaaaagtcgtgcagttactttctatgaaaacatcagatactttgtttgttgattttgtggattattggaccaaaagttcttctgaaatttttaaaatgctcaaggaacatctctctggacacattgttaaggtataccaattgttgaattgtaataacactaatgaaactagataggaaattctcaataccttcaaaaagttggtatccctcagggctcaattctgtcatcttttttgtgtcatttctatatggaagatttgattgatgaatacctatcgtttacgaaaaagaaaggatcagtgttgttacgagtagtcgacgatttcctctttataacagttaataaaaaggatgcaaaaaaatttttgaatttatctttaagaggtgagttgctgtcattcctaagttctaaccgttgaaggatttgagaaacacaatttttctacgagcctggagaaaacagtaataaactttgaaaatagtaatgggataataaacaatactttttttaatgaaagcaagaaaagaatgccattcttcggtttctctgtgaacatgaggtctcttgatacattgttagcatgtcctaaaattgatgaagccttatttaactctacatctgtagagctgacgaaacatatggggaaatcttttttttacaaaattctaaggtatactgtgtaactgaataatagctgacaaataatcagatcgagccttgcatcctttgcacaagtatttattgacattacccacaattcaaaattcaattcttgctgcaatatatataggctaggatactctatgtgtatgagagcacaagcatacttaaaaaggatgaaggatatatttattccccaaagaatgttcataacgggtgagtacttattttaactagaaaagtcattaattaaccttagatcttttgaatgttattggaagaaaaatttggaaaaagttggccgaaatattaggatatacgagtaggcgtttcttgtcctctgcagaagtcaaatggtacgtgtcggtctcgagacttcagcaatattgacacatcaggcttttttgtcttggaatgagagatggtttgaaaccctctttcaaatatcatccatgcttcgaacagctaatataccaatttcagtcattgactgatcttatcaagccgctaagaccagttttgcgacaggtgttatttttacatagaagaatagctgattaatgtcattttcaatttattatatacatcctttattactggtgtcttaaacaatattattactaagtatagctgacccccaaagcaagcatactataggatttctagtaaagtaaaattaatctcgttattagttttgattgacttgtctttatccttatacttttaagaaagattgacagtggttgctgactactgcccacatgcccattaaacgggagtggttaaacattaaaagtaatacatgaggctaatctcctttcatttagaataaggaaagtggttttctataatgaataatgcccgcactaatgcaaaaagacgaagattatcttctaaacaagggggattaagcatatccgaaggaaaagagagtaatatacccagtgttgttgaagaaagcaaggataatttggaacaagcttctgcagatgacaggctaaattttggtgaccgaattttggtaaaagccccaggttatccatggtggccggccttgctactgagacgaaaagaaactaaggatagtttgaatactaatagctcatttaatgtcttatataaggttttgttttttcctgacttcaattttgcatgggtgaaaagaaatagtgttaagccattattggattccgaaatagccaaatttcttggttcctcaaagcggaagtctaaagaacttattgaagcttatgaggcttcaaaaactcctcctgatttaaaggaggaatcttccaccgatgaggaaatggatagcttatcagctgctgaggagaagcctaattttttgcaaaaaagaaaatatcattgggagacatctcttgatgaatcagatgcggagagtatctccagcggatccttgatgtcaataacttctatttctgaaatgtatggtcctactgtcgcttcgacttctcgtagctctacgcagttaagtgaccaaaggtacc

SEQ ID NO: 112 - protein, 988 aa
MTEHHTPKSRILRFLENQYVYLCTLNDYVQLVLRGSPASSYSNICERLRSDVQTSFSIFLHSTVVGFDSKPDEGVQFSSPKCSQSELIANVVKQMFDESFERRRNLLMKGFSMNHEDFRAMHVNGVQNDLVSTFPNYLISILESKNWQLLLEIIGSDAMHYLLSKGSIFEALPNDNYLQISGIPLFKNNVFEETVSKKRKRTIETSITQNKSARKEVSWNSISISRFSIFYRSSYKKFKQDLYFNLHSICDRNTVHMWLQWIFPRQFGLINAFQVKQLHKVIPLVSQSTVVPKRLLKVYPLIEQTAKRLHRISLSKVYNHYCPYIDTHDDEKILSYSLKPNQVFAFLRSILVRVFPKLIWGNQRIFEIILKDLETFLKLSRYESFSLHYLMSNIKISEIEWLVLGKRSNAKMCLSDFEKRKQIFAEFIYWLYNSFIIPILQSFFYITESSDLRNRTVYFRKDIWKLLCRPFITSMKMEAFEKINENNVRMDTQKTTLPPAVIRLLPKKNTFRLITNLRKRFLIKMGSNKKMLVSTNQTLRPVASILKHLINEESSGIPFNLEVYMKLLTFKKDLLKHRMFGRKKYFVRIDIKSCYDRIKQDLMFRIVKKKLKDPEFVIRKYATIHATSDRATKNFVSEAFSYFDMVPFEKVVQLLSMKTSDTLFVDFVDYWTKSSSEIFKMLKEHLSGHIVKIGNSQYLQKVGIPQGSILSSFLCHFYMEDLIDEYLSFTKKKGSVLLRVVDDFLFITVNKKDAKKFLNLSLRGFEKHNFSTSLEKTVINFENSNGIINNTFFNESKKRMPFFGFSVNMRSLDTLLACPKIDEALFNSTSVELTKHMGKSFFYKILRSSLASFAQVFIDITHNSKFNSCCNIYRLGYSMCMRAQAYLKRMKDIFIPQRMFITDLLNVIGRKIWKKLAEILGYTSRRFLSSAEVKWLFCLGMRDGLKPSFKYHPCFEQLIYQFQSLTDLIKPLRPVLRQVLFLHRRIAD

SEQ ID NO: 113 - DNA (genomic), 15 bp; single-stranded, linear
caaaaccccaaaacc

SEQ ID NO: 114 - DNA, 16 bp; single-stranded, linear
ggggttttggggtttt

SEQ ID NO: 115 - DNA (genomic), 1762 bp; single-stranded, linear
  - 1..1762: /note= "gene encoding the 43 kDa telomerase protein subunit from Euplotes aediculatus"
ccccaaaaccccaaaaccccaaaacccctataaaaaaagaaaaaattgaggtagtttagaaataaaatattattcccgcacaaatggagatggatattgatttggatgatatagaaaatttacttcctaatacattcaacaagtatagcagctcttgtagtgacaagaaaggatgcaaaacattgaaatctggctcgaaatcgccttcattgactattccaaagttgcaaaaacaattagagttctacttctcggatgcaaatctttataacgattctttcttgagaaaattagttttaaaaagcggagagcaaagagtagaaattgaaacattactaatgtttaaataaaatcaggtaatgaggattattctattttttagatcacttcttaaggagcattatggagaaaattacttaatactaaaaggtaaacagtttggattatttccctagccaacaatgatgagtatattaaattcatatgagaatgagtcaaaggatctcgatacatcagacttaccaaagacaaactcgctataaaacgcaagaaaaagtttgataatcgaacagcagaagaacttattgcatttactattcgtatgggttttattacaattgttttaggtatcgacggtgaactcccgagtcttgagacaattgaaaaagctgtttacaactgaaggaatcgcagttctgaaagttctgatgtgtatgccattattttgtgaattaatctcaaatatcttatctcaatttaatggatagctatagaaacaaaccaaataaaccatgcaagtttaatggaatatacgttaaatcctttgggacaaatgcacactgaatttatattggattcttaaagcatagatacacagaatgctttagagactgatttagcttacaacagattacctgttttgattactcttgctcatctcttatatctttaaaagaagcaggcgaaatgaaaagaagactaaagaaagagatttcaaaatttgttgattcttctgtaaccggaattaacaacaagaatattagcaacgaaaaagaagaagagctatcacaatcctgattcttaaagatttcaaaaattccaggtaagagagatacattcattaaaattcatatattatagtttttcatttcacagctgttattttcttttatcttaacaatattttttgattagctggaagtaaaaagtatcaaataagagaagcgctagactgaggtaacttagcttattcacattcatagatcgaccttcatatatccaatacgatgataaggaaacagcagtcatccgttttaaaaatagtgctatgaggactaaatttttagagtcaagaaatggagccgaaatcttaatcaaaaagaattgcgtcgatattgcaaaagaatcgaactctaaatctttcgttaataagtattaccaatcttgattgattgaagagattgacgaggcaactgcacagaagatcattaaagaaataaagtaacttttattaattagagaataaactaaattactaatatagagatcagcgatcttcaattgacgaaataaaagctgaactaaagttagacaataaaaaatacaaaccttggtcaaaatattgaggaaggaaaagaagaccagttagcaaaagaaaaaataaggcaataaataaaatgagtacagaagtgaagaaataaaagatttatttttttcaataatttattgaaaagaggggttttggggttttggggttttgggg

SEQ ID NO: 116 - protein, 10 aa
PQNPKTPKPL

SEQ ID NO: 117 - protein, 6 aa
KKKKLR

SEQ ID NO: 118 - protein, 19 aa
FRNKILFPHKWRWILIWMI

SEQ ID NO: 119 - protein, 41 aa
KIYFLIHSTSIAALVVTRKDAKHCNLARNRLHCLFQSCKNN

SEQ ID NO: 120 - protein, 17 aa
SSTSRMQIFITILSCEN

SEQ ID NO: 121 - protein, 6 aa
KAESKE

SEQ ID NO: 122 - protein, 5 aa
KLKHY

SEQ ID NO: 123 - protein, 6 aa
CLNKIR

SEQ ID NO: 124 - protein, 19 aa
CGLFYFLDHFLRSIMEKIT

SEQ ID NO: 125 - protein, 16 aa
KVNSLDYFPSQQCCVY

SEQ ID NO: 126 - protein, 28 aa
IHMRMSQRISIHQTYQRQTRYKTQEKVC

SEQ ID NO: 127 - protein, 56 aa
SNSRRTYCIYYSYGFYYNCFRYRRCTPESCDNCKSCLQLKESQFCKFCCVCHYFVN

SEQ ID NO: 128 - protein, 134 aa
SQISYLNLMDSYRNKPNKPCKFNGIYVKSFGTNAHCIYIGFLKHRYTECFRDCFSLQQITCFDYSCSSLISLKEAGEMKRRLKKEISKFVDSSVTGINNKNISNEKEEELSQSCFLKISKIPGKRDTFIKIHIL

SEQ ID NO: 129 - protein, 17 aa
FFISQLLFSFILTIFFD

SEQ ID NO: 130 - protein, 7 aa
LEVKSIK

SEQ ID NO: 131 - protein, 4 aa
TEVT

SEQ ID NO: 132 - protein, 15 aa
LIHIHRSTFIYPIRC

SEQ ID NO: 133 - protein, 7 aa
GNSSHPF

SEQ ID NO: 134 - protein, 4 aa
CYED

SEQ ID NO: 135 - protein, 25 aa
IFRVKKWSRNLNQKELRRYCKRIEL

SEQ ID NO: 136 - protein, 19 aa
VLPILIDCRDCRGNCTEDH

SEQ ID NO: 137 - protein, 8 aa
RNKVTFIN

SEQ ID NO: 138 - protein, 13 aa
ITNIEISDLQLTK

SEQ ID NO: 139 - protein, 26 aa
TIKNTNLGQNIEEGKEDQLAKEKIRQ

SEQ ID NO: 140 - protein, 30 aa
IKCVQKCRNKRFIFFNNLLKRGVLGFWGFG

SEQ ID NO: 141 - protein, 42 aa
PKTPKPQNPYKKRKNCGSLEIKYYSRTNGDGYCFGCYRKFTS

SEQ ID NO: 142 - protein, 5 aa
YIQQV

SEQ ID NO: 143 - protein, 36 aa
CQERMQNIEIWLEIAFIDYSKVAKTIRVLLLGCKSL

SEQ ID NO: 144 - protein, 24 aa
RFFLEKISFKKRRAKSRNCNITNV

SEQ ID NO: 145 - protein, 11 aa
IKSGNEDYSIF

SEQ ID NO: 146 - protein, 12 aa
GALWRKLLNTKR

SEQ ID NO: 147 - protein, 108 aa
TVWIISLANNDEYIKFICECVKGSRYIRLTKDKLAIKRKKKFDNRTAEELIAFTIRMGFITIVLGIDGELPSLETIEKAVYNCRNRSSESSDVYAIILCINLKYLISI

SEQ ID NO: 148 - protein, 33 aa
WIAIETNQINHASLMEYTLNPLGQMHTEFILDS

SEQ ID NO: 149 - protein, 29 aa
SIDTQNALETDLAYNRLPVLITLAHLLYL

SEQ ID NO: 150 - protein, 9 aa
KKQAKCKED

SEQ ID NO: 151 - protein, 11 aa
RKRFQNLLILL

SEQ ID NO: 152 - protein, 21 aa
PELTTRILATKKKKSYHNPDS

SEQ ID NO: 153 - protein, 30 aa
RFQKFQVREIHSLKFIYYSFSFHSCYFLLS

SEQ ID NO: 154 - protein, 8 aa
QYFLISWK

SEQ ID NO: 155 - protein, 11 aa
KVSNKRSARLR

SEQ ID NO: 156 - protein, 87 aa
LSLFTFIDRPSYIQYDDKETAVIRFKNSAMRTKFLESRNGAEILIKKNCVDIAKESNSKSFVNKYYQSCLIEEIDEATAQKIIKEIK

SEQ ID NO: 157 - protein, 6 aa
LLLIRE

SEQ ID NO: 158 - protein, 5 aa
TKLLI

SEQ ID NO: 159 - protein, 17 aa
RSAIFNCRNKSCTKVRQ

SEQ ID NO: 160 - protein, 16 aa
KIQTLVKILRKEKKTS

SEQ ID NO: 161 - protein, 4 aa
QKKK

SEQ ID NO: 162 - protein, 29 aa
NEYRSEEIKDLFFSIIYCKEGFWGFGVLG

SEQ ID NO: 163 - protein, 18 aa
PKPQNPKTPIKKEKIEVV

SEQ ID NO: 164 - protein, 94 aa
NIIPAQMEMDIDLDDIENLLPNTFNKYSSSCSDKKGCKTLKSGSKSPSLTIPKLQKQLEFYFSDANLYNDSFLRKLVLKSGEQRVEIETLLMFK

SEQ ID NO: 165 - protein, 34 aa
NQVMRIILFFRSLLKEHYGENYLILKGKQFGLFP

SEQ ID NO: 166 - protein, 28 aa
PTMMSILNSYENESKDLDTSDLPKTNSL

SEQ ID NO: 167 - protein, 27 aa
NARKSLIIEQQKNLLHLLFVWVLLQLF

SEQ ID NO: 168 - protein, 46 aa
VSTVNSRVLRQLKKLFTTEGIAVLKVLMCMPLFCELISNILSQFNG

SEQ ID NO: 169 - protein, 4 aa
KQTK

SEQ ID NO: 170 - protein, 4 aa
TMQV

SEQ ID NO: 171 - protein, 4 aa
WNIR

SEQ ID NO: 172 - protein, 16 aa
ILWDKCTLNLYWILKA

SEQ ID NO: 173 - protein, 5 aa
IHRML

SEQ ID NO: 174 - protein, 42 aa
LTTDYLFCLLLLISYIFKRSRRNEKKTKERDFKICCFFCNRN

SEQ ID NO: 175 - protein, 4 aa
QQEY

SEQ ID NO: 176 - protein, 20 aa
QRKRRRAITILILKDFKNSR

SEQ ID NO: 177 - protein, 5 aa
ERYIH

SEQ ID NO: 178 - protein, 45 aa
NSYIIVFHFTAVIFFYLNNIFCLAGSKKYQIREALDCGNLAYSHS

SEQ ID NO: 179 - protein, 27 aa
IDLHISNTMIRKQQSSVLKIVLCGLNF

SEQ ID NO: 180 - protein, 8 aa
SQEMEPKS

SEQ ID NO: 181 - protein, 41 aa
SKRIASILQKNRTLNLSLISITNLDCLKRLTRQLHRRSLKK

SEQ ID NO: 182 - protein, 4 aa
SNFY

SEQ ID NO: 183 - protein, 7 aa
LENKLNY

SEQ ID NO: 184 - protein, 53 aa
YRDQRSSIDEIKAELKLDNKKYKPWSKYCGRKRRPVSKRKNKAINKMSTEVKK

SEQ ID NO: 185 - protein, 6 aa
KIYFFQ

SEQ ID NO: 186 - protein, 13 aa
FIEKRGFGVLGFW

SEQ ID NO: 187 - protein, 1007 aa
EVDVDNQADNHGIHSALKTCEEIKEAKTLYSWIQKVIRCRNQSQSHYKDLEDIKIFAQTNIVATPRDYNEEDFKVIARKEVFSTGLMIELIDKCLVELLSSSDVSDRQKLQCFGFQLKGNQLAKTHLLTALSTQKQYFFQDEWNQVRAMIGNELFRHLYTKYLIFQRTSEGTLVQFCGNNVFDHLKVNDKFDKKQKGGAADMNEPRCCSTCKYNVKNEKDHFLNNINVPNWNNMKSRTRIFYCTHFNRNNQFFKKHEFVSNKNNISAMDRAQTIFTNIFRFNRIRKKLKDKVIEKIAYMLEKVKDFNFNYYLTKSCPLPENWRERKQKIENLINKTREEKSKYYEELFSYTTDNKCVTQFINEFFYNILPKDFLTGRNRKNFQKKVKKYVELNKHELIHKNLLLEKINTREISWMQVETSAKHFYYFDHENIYVLWKLLRWIFEDLVVSLIRCFFYVTEQQKSYSKTYYYRKNIWDVIMKMSIADLKKETLAEVQEKEVEEWKKSLGFAPGKLRLIPKKTTFRPIMTFNKKIVNSDRKTTKLTTNTKLLNSHLMLKTLKNRMFKDPFGFAVFNYDDVMKKYEEFVCKWKQVGQPKLFFATMDIEKCYDSVNREKLSTFLKTTKLLSSDFWIMTAQILKRKNNIVIDSKNFRKKEMKDYFRQKFQKIALEGGQYPTLFSVLENEQNDLNAKKTLIVEAKQRNYFKKDNLLQPVINICQYNYINFNGKFYKQTKGIPQGLCVSSILSSFYYATLEESSLGFLRDESMNPENPNVNLLMRLTDDYLLITTQENNAVLFIEKLINVSRENGFKFNMKKLQTSFPLSPSKFAKYGMDSVEEQNIVQDYCDWIGISIDMKTLALMPNINLRIEGILCTLNLNMQTKKASMWLKKKLKSFLMNNITHYFRKTITTEDFANKTLNKLFISGGYKYMQCAKEYKDHFKKNLAMSSMIDLEVSKIIYSVTRAFFKYLVCNIKDTIFGEEHYPDFFLSTLKHFIEIFSTKKYIFNRVC

SEQ ID NO: 188 - protein, 699 aa
ELELEMQENQNDIQVRVKIDDPKQYLVNVTAACLLQEGSYYQDKDERRYIITKALLEVAESDPEFICQLAVYIRNELYIRTTTNYIVAFCVVHKNTQPFIEKYFNKAVLLPNDLLEVCEFAQVLYIFDATEFKNLYLDRILSQDIRKELTFRKCLQRCVRSKFSEFNEYQLGKYCTESQRKKTMFRYLSVTNKQKWDQTKKKRKENLLTKLQAIKESEDKSKRETGDIMNVEDAIKALKPAVMKKIAKRQNAMKKHMKAPKIPNSTLESKYLTFKDLIKFCHISEPKERVYKILGKKYPKTEEEYKAAFGDSASAPFNPELAGKRMKIEISKTWENELSAKGNTAEVWDNLISSNQLPYMAMLRNLSNILKAGVSDTTHSIVINKICEPKAVENSKMFPLQFFSAIEAVNEAVTKGFKAKKRENMNLKGQIEAVKEVVEKTDEEKKDMELEQTEEGEFVKVNEGIGKQYINSIELAIKIAVNKNLDEIKGHTAIFSDVSGSMSTSMSGGAKKYGSVRTCLECALVLGLMVKQRCEKSSFYIFSSPSSQCNKCYLEVDLPGDELRPSMQKLLQEKGKLGGGTDFPYECIDEWTKNKTHVDNIVILSDMMIAEGYSDINVRGSSIVNSIKKYKDEVNPNIKIFAVDLEGYGKCLNLGDEFNENNYIKIFGMSDSILKFISAKQGGANMVEVIKNFALQKIG

SEQ ID NO: 189 - protein, 897 aa
LSTQKQYFFQDEWNQVRAMIGNELFRHLYTKYLIFQRTSEGTLVQFCGNNVFDHLKVNDKFDKKQKGGAADMNEPRCCSTCKYNVKNEKDHFLNNINVPNWNNMKSRTRIFYCTHFNRNNQFFKKHEFVSNKNNISAMDRAQTIFTNIFRFNRIRKKLKDKVIEKIAYMLEKVKDFNFNYYLTKSCPLPENWRERKQKIENLINKTREEKSKYYEELFSYTTDNKCVTQFINEFFYNILPKDFLTGRNRKNFQKKVKKYVELNKHELIHKNLLLEKINTREISWMQVETSAKHFYYFDHENIYVLWKLLRWIFEDLVVSLIRCFFYVTEQQKSYSKTYYYRKNIWDVIMKMSIADLKKETLAEVQEKEVEEWKKSLGFAPGKLRLIPKKTTFRPIMTFNKKIVNSDRKTTKLTTNTKLLNSHLMLKTLKNRMFKDPFGFAVFNYDDVMKKYEEFVCKWKQVGQPKLFFATMDIEKCYDSVNREKLSTFLKTTKLLSSDFWIMTAQILKRKNNIVIDSKNFRKKEMKDYFRQKFQKIALEGGQYPTLFSVLENEQNDLNAKKTLIVEAKQRNYFKKDNLLQPVINICQYNYINFNGKFYKQTKGIPQGLCVSSILSSFYYATLEESSLGFLRDESMNPENPNVNLLMRLTDDYLLITTQENNAVLFIEKLINVSRENGFKFNMKKLQTSFPLSPSKFAKYGMDSVEEQNIVQDYCDWIGISIDMKTLALMPNINLRIEGILCTLNLNMQTKKASMWLKKKLKSFLMNNITHYFRKTITTEDFANKTLNKLFISGGYKYMQCAKEYKDHFKKNLAMSSMIDLEVSKIIYSVTRAFFKYLVCNIKDTIFGEEHYPDFFLSTLKHFIEIFSTKKYIFNRVCMILKAKEAKLKSDQCQSLIQ

SEQ ID NO: 190 - protein, 840 aa
MSRRNQKKPQAPIGNETNLDFVLQNLEVYKSQIEHYKTQQQQIKEEDLKLLKFKNQDQDGNSGNDDDDEENNSNKQQELLRRVNQIKQQVQLIKKVGSKVEKDLNLNEDENKKNGLSEQQVKEEQLRTITEEQVKYQNLVFNMDYQLDLNESGGHRRHRRETDYDTEKWFEISHDQKNYVSIYANQKTSYCWWLKDYFNKNNYDHLNVSINRLETEAEFYAFDDFSQTIKLTNNSYQTVNIDVNFDNNLCILALLRFLLSLERFNILNIRSSYTRNQYNFEKIGELLETIFAVVFSHRHLQGIHLQVPCEAFQYLVNSSSQISVKDSQLQVYSFSTDLKLVDTNKVQDYFKFLQEFPRLTHVSQQAIPVSATNAVENLNVLLKKVKHANLNLVSIPTQFNFDFYFVNLQHLKLEFGLEPNILTKQKLENLLLSIKQSKNLKFLRLNFYTYVAQETSRKQILKQATTIKNLKNNKNQEETPETKDETPSESTSGMKFFDHLSELTELEDFSVNLQATQEIYDSLHKLLIRSTNLKKFKLSYKYEMEKSKMDTFIDLKNIYETLNNLKRCSVNISNPHGNISYELTNKDSTFYKFKLTLNQELQHAKYTFKQNEFQFNNVKSAKIESSSLESLEDIDSLCKSIASCKNLQNVNIIASLLYPNNIQKNPFNKPNLLFFKQFEQLKNLENVSINCILDQHILNSISEFLEKNKKIKAFILKRYYLLQYYLDYTKLFKTLQQLPELNQVYINQQLEELTVSEVHKQVWENHKQKAFYEPLCEFIKESSQTLQLIDFDQNTVSDDSIKKILESISESKYHHYLRLNPSQSSSLIKSENEEIQELLK

SEQ ID NO: 191 - protein, 83 aa
DIDLDDIENLLPNTFNKYSSSCSDKKGCKTLKSGSKSPSLTIPKLQKQLEFYFSDANLYNDSFLRKLVLKSGEQRVEIETLLM

SEQ ID NO: 192 - protein, 100 aa
NVKSAKIESSSLESLEDIDSLCKSIASCKNLQNVNIIASLLYPNNIQKNPFNKPNLLFFKQFEQLKNLENVSINCILDQHILNSISEFLEKNKKIKAFIL

SEQ ID NO: 193 - protein, 85 aa
MEMDIDLDDIENLLPNTFNKYSSSCSDKKGCKTLKSGSKSPSLTIPKLQKQLEFYFSDANLYNDSFLRKLVLKSGEQRVEIETLL

SEQ ID NO: 194 - protein, 99 aa
IELAIKIAVNKNLDEIKGHTAIFSDVSGSMSTSMSGGAKKYGSVRTCLECALVLGLMVKQRCEKSSFYIFSSPSSQCNKCYLEVDLPGDELRPSMQKLL

SEQ ID NO: 195 - protein, 13 aa
  Peptide 1..13: /note= "consensus telomerase RT sequence from motif A"
  Modified-site 1: /product= "OTHER" /note= "Xaa = hydrophobic amino acid, Ala, Leu, Ile, Val, Pro, Phe, Trp or Met"
  Modified-site 4: /product= "OTHER" /note= "Xaa = hydrophobic amino acid, Ala, Leu, Ile, Val, Pro, Phe, Trp or Met"
  Modified-site 6: /product= "OTHER" /note= "Xaa = hydrophobic amino acid, Ala, Leu, Ile, Val, Pro, Phe, Trp or Met"
  Modified-site 10: /product= "OTHER" /note= "Xaa = hydrophobic amino acid, Ala, Leu, Ile, Val, Pro, Phe, Trp or Met"
  Modified-site 13: /product= "OTHER" /note= "Xaa = hydrophobic amino acid, Ala, Leu, Ile, Val, Pro, Phe, Trp or Met"
XXXXDXXXXXXXX

SEQ ID NO: 196 - protein, 13 aa
  Peptide 1..13: /note= "consensus telomerase RT sequence from motif B"
  Modified-site 1: /product= "OTHER" /note= "Xaa = hydrophobic amino acid, Ala, Leu, Ile, Val, Pro, Phe, Trp or Met"
XXXXXXQGXXXSP

SEQ ID NO: 197 - protein, 10 aa
  Peptide 1..10: /note= "consensus telomerase RT sequence from motif C"
  Modified-site 1: /product= "OTHER" /note= "Xaa = hydrophobic amino acid, Ala, Leu, Ile, Val, Pro, Phe, Trp or Met"
  Modified-site 5: /product= "OTHER" /note= "Xaa = hydrophobic amino acid, Ala, Leu, Ile, Val, Pro, Phe, Trp or Met"
  Modified-site 8..10: /product= "OTHER" /note= "Xaa = hydrophobic amino acid, Ala, Leu, Ile, Val, Pro, Phe, Trp or Met"
XXXYXDDXXX

SEQ ID NO: 198 - protein, 8 aa
  Peptide 1..8: /note= "consensus telomerase RT sequence from motif D"
  Modified-site 2: /product= "OTHER" /note= "Xaa = hydrophobic amino acid, Ala, Leu, Ile, Val, Pro, Phe, Trp or Met"
  Modified-site 4: /product= "OTHER" /note= "Xaa = hydrophobic amino acid, Ala, Leu, Ile, Val, Pro, Phe, Trp or Met"
GXXXXXXK

SEQ ID NO: 199 - protein, 8 aa
  Peptide 1..8: /note= "consensus telomerase RT sequence from motif E"
  Modified-site 1: /product= "OTHER" /note= "Xaa = hydrophobic amino acid, Ala, Leu, Ile, Val, Pro, Phe, Trp or Met"
  Modified-site 3: /product= "OTHER" /note= "Xaa = hydrophobic amino acid, Ala, Leu, Ile, Val, Pro, Phe, Trp or Met"
  Modified-site 6: /product= "OTHER" /note= "Xaa = hydrophobic amino acid, Ala, Leu, Ile, Val, Pro, Phe, Trp or Met"
  Modified-site 8: /product= "OTHER" /note= "Xaa = hydrophobic amino acid, Ala, Leu, Ile, Val, Pro, Phe, Trp or Met"
XXXLGXXX

SEQ ID NO: 200 - protein, 34 aa
  Peptide 1..34: /note= "motif A peptide from Dong (LINE)"
KNRNLHCTYIDYKKAFDSIPHSWLIQVLEIYKIN

SEQ ID NO: 201 - protein, 35 aa
  Peptide 1..35: /note= "motif B peptide from Dong (LINE)"
RQIAIKKGIYQGDSLSPLWFCLALNPLSHQLHNDR

SEQ ID NO: 202 - protein, 43 aa
  Peptide 1..43: /note= "motif C and D peptide from Dong (LINE)"
HLIYMDDIKLYAKNDKEMKKLIDTTTIFSNDISMQFGLDKCKT

SEQ ID NO: 203 - protein, 11 aa
  Peptide 1..11: /note= "motif E peptide from Dong (LINE)"
KCLYKYLGFQQ

SEQ ID NO: 204 - protein, 34 aa
  Peptide 1..34: /note= "motif A peptide from Saccharomyces cerevisiae cytochrome oxidase group II intron 1-encoded mitochondrial protein"
FGGSNWFREVDLKKCFDTISHDLIIKELKRYISD

SEQ ID NO: 205 - protein, 35 aa
  Peptide 1..35: /note= "motif B peptide from Saccharomyces cerevisiae cytochrome oxidase group II intron 1-encoded mitochondrial protein"
HVPVGPRVCVQGAPTSPALCNAVLLRLDRRLAGLA

SEQ ID NO: 206 - protein, 25 aa
  Peptide 1..25: /note= "motif D peptide from Saccharomyces cerevisiae cytochrome oxidase group II intron 1-encoded mitochondrial protein"
KIIKRDLNNFLNSLGLTINEEKTLI

SEQ ID NO: 207 - protein, 34 aa
  Peptide 1..34: /note= "motif A peptide from HIV RT"
LKKKKSVTVLDVGDAYFSVPLDEDFRKYTAFTIP

SEQ ID NO: 208 - protein, 35 aa
  Peptide 1..35: /note= "motif B peptide from HIV RT"
GIRYQYNVLPQGWKGSPAIFQSSMTKILEPFRKQN

SEQ ID NO: 209 - protein, 17 aa
  Peptide 1..17: /note= "motif C peptide from HIV RT"
IYQYMDDLYVGSHLEIG

SEQ ID NO: 210 - protein, 37 aa
  Peptide 1..37: /note= "motif D and E peptide from HIV RT"
HRTKIEELRQHLLRWGLTTPDKKHQKEPPFLWMGYEL

SEQ ID NO: 211 - protein, 38 aa
  Peptide 1..38: /note= "motif C and D peptide from Saccharomyces cerevisiae ESTp (L8543.12)"
ILKLADDFLIISTDQQQVINIKKLAMGGFQKYNAKANR

SEQ ID NO: 212 - protein, 11 aa
  Peptide 1..11: /note= "motif E peptide from Saccharomyces cerevisiae ESTp (L8543.12)"
IRSKSSKGIFR

SEQ ID NO: 213 - protein, 39 aa
LQKQLEFYFSDANLYNDSFLRKLVLKSGEQRVEIETLLM

SEQ ID NO: 214 - protein, 38 aa
ICHQXEYYFGDFNLPRDKFLKEQIKLDEGWVPLEIMIK

SEQ ID NO: 215 - protein, 38 aa
ICEQIEYYFGDHNLPRDKFLKQQILLDDGWVPLETMIK

SEQ ID NO: 216 - protein, 39 aa
ILRQVEYYFGDANLNRDKFLREQIGKNEDGWVPLSVLVT

SEQ ID NO: 217 - protein, 38 aa
CLKQVEFYFSEFNFPYDRFLRTTAEKNDGWVPISTIAT

SEQ ID NO: 218 - DNA (genomic), 2421 bp; single-stranded, linear
  CDS 92..2251: /codon= (seq: "taa", aa: Gln) /codon= (seq: "tag", aa: Gln) /codon= (seq: "tga", aa: TRM) /product= "Tetrahymena thermophila 80 kDa protein subunit"
aactcatttaattactaatttaatcaacaagattgataaaaagcagtaaataaaacccaatagatttaatttagaaagtatcaattgaaaaatggaaattgaaaacaactaagcacaatagccaaaagccgaaaaattgtggtgggaacttgaattagagatgcaagaaaaccaaaatgatatataagttagggttaagattgacgatcctaagcaatatctcgtgaacgtcactgcagcatgtttgttgtaggaaggtagttactactaagataaagatgaaagaagatatatcatcactaaagcacttcttgaggtggctgagtctgatcctgagttcatctgctagttggcagtctacatccgtaatgaactttacatcagaactaccactaactacattgtagcattttgtgttgtccacaagaatactcaaccattcatcgaaaagtacttcaacaaagcagtacttttgcctaatgacttactggaagtctgtgaatttgcataggttctctatatttttgatgcaactgaattcaaaaatttgtatcttgataggatactttcataagatattcgtaaggaactcactttccgtaagtgtttacaaagatgcgtcagaagcaagttttctgaattcaacgaatactaacttggtaagtattgcactgaatcctaacgtaagaaaacaatgttccgttacctctcagttaccaacaagtaaaagtgggattaaactaagaagaagagaaaagagaatctcttaaccaaactttaggcaataaaggaatctgaagataagtccaagagagaaactggagacataatgaacgttgaagatgcaatcaaggctttaaaaccagcagttatgaagaaaatagccaagagatagaatgccatgaagaaacacatgaaggcacctaaaattcctaactctaccttggaatcaaagtacttgaccttcaaggatctcattaagttctgccatatttctgagcctaaagaaagagtctataagatccttggtaaaaaataccctaagaccgaagaggaatacaaagcagcctttggtgattctgcatctgcacccttcaatcctgaattggctggaaagcgtatgaagattgaaatctctaaaacatgggaaaatgaactcagtgcaaaaggcaacactgctgaggtttgggataatttaatttcaagcaattaactcccatatatggccatgttacgtaacttgtctaacatcttaaaagccggtgtttcagatactacacactctattgtgatcaacaagatttgtgagcccaaggccgttgagaactccaagatgttccctcttcaattctttagtgccattgaagctgttaatgaagcagttactaagggattcaaggccaagaagagagaaaatatgaatcttaaaggtcaaatcgaagcagtaaaggaagttgttgaaaaaaccgatgaagagaagaaagatatggagttggagtaaaccgaagaaggagaatttgttaaagtcaacgaaggaattggcaagcaatacattaactccattgaacttgcaatcaagatagcagttaacaagaatttagatgaaatcaaaggacacactgcaatcttctctgatgtttctggttctatgagtacctcaatgtcaggtggagccaagaagtatggttccgttcgtacttgtctcgagtgtgcattagtccttggtttgatggtaaaataacgttgtgaaaagtcctcattctacatcttcagttcacctagttctcaatgcaataagtgttacttagaagttgatctccctggagacgaactccgtccttctatgtaaaaacttttgcaagagaaaggaaaacttggtggtggtactgatttcccctatgagtgcattgatgaatggacaaagaataaaactcacgtagacaatatcgttattttgtctgatatgatgattgcagaaggatattcagatatcaatgttagaggcagttccattgttaacagcatcaaaaagtacaaggatgaagtaaatcctaacattaaaatctttgcagttgacttagaaggttacggaaagtgccttaatctaggtgatgagttcaatgaaaacaactacatcaagatattcggtatgagcgattcaatcttaaagttcatttcagccaagcaaggaggagcaaatatggtcgaagttatcaaaaactttgcccttcaaaaaataggacaaaagtgagtttcttgagattcttctataacaaaaatctcaccccacttttttgttttattgcatagccattatgaaatttaaattattatctatttatttaagttacttacatagtttatgtatcgcagtctattagcctattcaaatgattctgcaaagaacaaaaaagattaaaa

SEQ ID NO: 219 - protein, 719 aa
MEIENNQAQQPKAEKLWWELELEMQENQNDIQVRVKIDDPKQYLVNVTAACLLQEGSYYQDKDERRYIITKALLEVAESDPEFICQLAVYIRNELYIRTTTNYIVAFCVVHKNTQPFIEKYFNKAVLLPNDLLEVCEFAQVLYIFDATEFKNLYLDRILSQDIRKELTFRKCLQRCVRSKFSEFNEYQLGKYCTESQRKKTMFRYLSVTNKQKWDQTKKKRKENLLTKLQAIKESEDKSKRETGDIMNVEDAIKALKPAVMKKIAKRQNAMKKHMKAPKIPNSTLESKYLTFKDLIKFCHISEPKERVYKILGKKYPKTEEEYKAAFGDSASAPFNPELAGKRMKIEISKTWENELSAKGNTAEVWDNLISSNQLPYMAMLRNLSNILKAGVSDTTHSIVINKICEPKAVENSKMFPLQFFSAIEAVNEAVTKGFKAKKRENMNLKGQIEAVKEVVEKTDEEKKDMELEQTEEGEFVKVNEGIGKQYINSIELAIKIAVNKNLDEIKGHTAIFSDVSGSMSTSMSGGAKKYGSVRTCLECALVLGLMVKQRCEKSSFYIFSSPSSQCNKCYLEVDLPGDELRPSMQKLLQEKGKLGGGTDFPYECIDEWTKNKTHVDNIVILSDMMIAEGYSDINVRGSSIVNSIKKYKDEVNPNIKIFAVDLEGYGKCLNLGDEFNENNYIKIFGMSDSILKFISAKQGGANMVEVIKNFALQKIGQK

SEQ ID NO: 220 - DNA (genomic), 2829 bp; single-stranded, linear
  CDS 47..2665: /codon= (seq: "taa", aa: Gln) /codon= (seq: "tag", aa: Gln) /codon= (seq: "tga", aa: TRM) /product= "Tetrahymena thermophila 95 kDa protein subunit"
tcaatactattaattaataaataaaaaaaagcaaactacaaagaaaatgtcaaggcgtaactaaaaaaagccataggctcctataggcaatgaaacaaatcttgattttgtattacaaaatctagaagtttacaaaagccagattgagcattataagacctagtagtaatagatcaaagaggaggatctcaagcttttaaagttcaaaaattaagattaggatggaaactctggcaacgatgatgatgatgaagaaaacaactcaaataaataataagaattattaaggagagtcaattagattaagtagcaagtttaattgataaaaaaagttggttctaaggtagagaaagatttgaatttgaacgaagatgaaaacaaaaagaatggactttctgaatagcaagtgaaagaagagtaattaagaacgattactgaagaataggttaagtattaaaatttagtatttaacatggactaccagttagatttaaatgagagtggtggccatagaagacacagaagagaaacagattatgatactgaaaaatggtttgaaatatctcatgaccaaaaaaattatgtatcaatttacgccaactaaaagacatcatattgttggtggcttaaagattattttaataaaaacaattatgatcatcttaatgtaagcattaacagactagaaactgaagccgaattctatgcctttgatgatttttcacaaacaatcaaacttactaataattcttactagactgttaacatagacgttaattttgataataatctctgtatactcgcattgcttagatttttattatcactagaaagattcaatattttgaatataagatcttcttatacaagaaattaatataattttgagaaaattggtgagctacttgaaactatcttcgcagttgtcttttctcatcgccacttacaaggcattcatttacaagttccttgcgaagcgttctaatatttagttaactcctcatcataaattagcgttaaagatagctaattataggtatactctttctctacagacttaaaattagttgacactaacaaagtccaagattattttaagttcttataagaattccctcgtttgactcatgtaagctagtaggctatcccagttagtgctactaacgctgtagagaacctcaatgttttacttaaaaaggtcaagcatgctaatcttaatttagtttctatccctacctaattcaattttgatttctactttgttaatttataacatttgaaattagagtttggattagaaccaaatattttgacaaaacaaaagcttgaaaatctacttttgagtataaaataatcaaaaaatcttaaatttttaagattaaacttttacacctacgttgcttaagaaacctccagaaaacagatattaaaacaagctacaacaatcaaaaatctcaaaaacaataaaaatcaagaagaaactcctgaaactaaagatgaaactccaagcgaaagcacaagtggtatgaaattttttgatcatctttctgaattaaccgagcttgaagatttcagcgttaacttgtaagctacccaagaaatttatgatagcttgcacaaacttttgattagatcaacaaatttaaagaagttcaaattaagttacaaatatgaaatggaaaagagtaaaatggatacattcatagatcttaagaatatttatgaaaccttaaacaatcttaaaagatgctctgttaatatatcaaatcctcatggaaacatttcttatgaactgacaaataaagattctactttttataaatttaagctgaccttaaactaagaattataacacgctaagtatacttttaagtagaacgaattttaatttaataacgttaaaagtgcaaaaattgaatcttcctcattagaaagcttagaagatattgatagtctttgcaaatctattgcttcttgtaaaaatttacaaaatgttaatattatcgccagtttgctctatcccaacaatatttagaaaaatcctttcaataagcccaatcttctatttttcaagcaatttgaataattgaaaaatttggaaaatgtatctatcaactgtattcttgatcagcatatacttaattctatttcagaattcttagaaaagaataaaaaaataaaagcattcattttgaaaagatattatttattacaatattatcttgattatactaaattatttaaaacacttcaatagttacctgaattaaattaagtttacattaattagcaattagaagaattgactgtgagtgaagtacataagtaagtatgggaaaaccacaagcaaaaagctttctatgaaccattatgtgagtttatcaaagaatcatcctaaaccctttagctaatagattttgaccaaaacactgtaagtgatgactctattaaaaagattttagaatctatatctgagtctaagtatcatcattatttgagattgaaccctagttaatctagcagtttaattaaatctgaaaacgaagaaatttaagaacttctcaaagcttgcgacgaaaaaggtgttttagtaaaagcatactataaattccctctatgtttaccaactggtacttattacgattacaattcagatagatggtgattaattaaatattagtttaaataaatattaaatattgaatatttctttgcttattatttgaataatacatacaatagtcatttttagtgttttgaatatattttagttatttaattcattattttaagtaaataattatttttcaatcattttttaaaaaatcg

SEQ ID NO: 221 - protein, 872 aa
MSRRNQKKPQAPIGNETNLDFVLQNLEVYKSQIEHYKTQQQQIKEEDLKLLKFKNQDQDGNSGNDDDDEENNSNKQQELLRRVNQIKQQVQLIKKVGSKVEKDLNLNEDENKKNGLSEQQVKEEQLRTITEEQVKYQNLVFNMDYQLDLNESGGHRRHRRETDYDTEKWFEISHDQKNYVSIYANQKTSYCWWLKDYFNKNNYDHLNVSINRLETEAEFYAFDDFSQTIKLTNNSYQTVNIDVNFDNNLCILALLRFLLSLERFNILNIRSSYTRNQYNFEKIGELLETIFAVVFSHRHLQGIHLQVPCEAFQYLVNSSSQISVKDSQLQVYSFSTDLKLVDTNKVQDYFKFLQEFPRLTHVSQQAIPVSATNAVENLNVLLKKVKHANLNLVSIPTQFNFDFYFVNLQHLKLEFGLEPNILTKQKLENLLLSIKQSKNLKFLRLNFYTYVAQETSRKQILKQATTIKNLKNNKNQEETPETKDETPSESTSGMKFFDHLSELTELEDFSVNLQATQEIYDSLHKLLIRSTNLKKFKLSYKYEMEKSKMDTFIDLKNIYETLNNLKRCSVNISNPHGNISYELTNKDSTFYKFKLTLNQELQHAKYTFKQNEFQFNNVKSAKIESSSLESLEDIDSLCKSIASCKNLQNVNIIASLLYPNNIQKNPFNKPNLLFFKQFEQLKNLENVSINCILDQHILNSISEFLEKNKKIKAFILKRYYLLQYYLDYTKLFKTLQQLPELNQVYINQQLEELTVSEVHKQVWENHKQKAFYEPLCEFIKESSQTLQLIDFDQNTVSDDSIKKILESISESKYHHYLRLNPSQSSSLIKSENEEIQELLKACDEKGVLVKAYYKFPLCLPTGTYYDYNSDRW

SEQ ID NO: 222 - protein, 884 aa
  Protein 1..884: /note= "Saccharomyces cerevisiae ESTp (L8543.12)"
MKILFEFIQDKLDIDLQTNSTYKENLKCGHFNGLDEILTTCFALPNSRKIALPCLPGDLSHKAVIDHCIIYLLTGELYNNVLTFGYKIARNEDVNNSLFCHSANVNVTLLKGAAWKMFHSLVGTYAFVDLLINYTVIQFNGQFFTQIVGNRCNEPHLPPKWVQRSSSSSATAAQIKQLTEPVTNKQFLHKLNINSSSFFPYSKILPSSSSIKKLTDLREAIFPTNLVKIPQRLKVRINLTLQKLLKRHKRLNYVSILNSICPPLEGTVLDLSHLSRQSPKERVLKFIIVILQKLLPQEMFGSKKNKGKIIKNLNLLLSLPLNGYLPFDSLLKKLRLKDFRWLFISDIWFTKHNFENLNQLAICFISWLFRQLIPKIIQTFFYCTEISSTVTIVYFRHDTWNKLITPFIVEYFKTYLVENNVCRNHNSYTLSNFNHSKMRIIPKKSNNEFRIIAIPCRGADEEEFTIYKENHKNAIQPTQKILEYLRNKRPTSFTKIYSPTQIADRIKEFKQRLLKKFNNVLPELYFMKFDVKSCYDSIPRMECMRILKDALKNENGFFVRSQYFFNTNTGVLKLFNVVNASRVPKPYELYIDNVRTVHLSNQDVINVVEMEIFKTALWVEDKCYIREDGLFQGSSLSAPIVDLVYDDLLEFYSEFKASPSQDTLILKLADDFLIISTDQQQVINIKKLAMGGFQKYNAKANRDKILAVSSQSDDDTVIQFCAMHIFVKELEVWKHSSTMNNFHIRSKSSKGIFRSLIALFNTRISYKTIDTNLNSTNTVLMQIDHVVKNISECYKSAFKDLSINVTQNMQFHSFLQRIIEMTVSGCPITKCDPLIEYEVRFTILNGFLESLSSNTSKFKDNIILLRKEIQHLQAYIYIYIHIVN

SEQ ID NO: 223 - protein, 42 aa
LCVSYILSSFYYANLEENALQFLRKESMDPEKPETNLLMRLT

SEQ ID NO: 224 - protein, 42 aa
LCVSSILSSFYYATLEESSLGFLRDESMNPENPNVNLLMRLT

SEQ ID NO: 225 - DNA (genomic), 2631 bp; single-stranded, linear
  - 1..2631: /note= "Saccharomyces cerevisiae EST2"
atttatactcatgaaaatcttattcgagttcattcaagacaagcttgacattgatctacagaccaacagtacttacaaagaaaatttaaaatgtggtcacttcaatggcctcgatgaaattctaactacgtgtttcgcactaccaaattcaagaaaaatagcattaccatgccttcctggtgacttaagccacaaagcagtcattgatcactgcatcatttacctgttgacgggcgaattatacaacaacgtactaacatttggctataaaatagctagaaatgaagatgtcaacaatagtcttttttgccattctgcaaatgttaacgttacgttactgaaaggcgctgcttggaaaatgttccacagtttggtcggtacatacgcattcgttgatttattgatcaattatacagtaattcaatttaatgggcagtttttcactcaaatcgtgggtaacagatgtaacgaacctcatctgccgcccaaatgggtccaacgatcatcctcatcatccgcaactgctgcgcaaatcaaacaacttacagaaccagtgacaaataaacaattcttacacaagctcaatataaattcctcttctttttttccttatagcaagatccttccttcatcatcatctatcaaaaagctaactgacttgagagaagctatttttcccacaaatttggttaaaattcctcagagactaaaggtacgaattaatttgacgctgcaaaagctattaaagagacataagcgtttgaattacgtttctattttgaatagtatttgcccaccattggaagggaccgtattggacttgtcgcatttgagtaggcaatcaccaaaggaacgagtcttgaaatttatcattgttattttacagaagttattaccccaagaaatgtttggctcaaagaaaaataaaggaaaaattatcaagaatctaaatcttttattaagtttacccttaaatggctatttaccatttgatagtttgttgaaaaagttaagattaaaggattttcggtggttgttcatttctgatatttggttcaccaagcacaattttgaaaacttgaatcaattggcgatttgtttcatttcctggctatttagacaactaattcccaaaattatacagacttttttttactgcaccgaaatatcttctacagtgacaattgtttactttagacatgatacttggaataaacttatcaccccttttatcgtagaatattttaagacgtacttagtcgaaaacaacgtatgtagaaaccataatagttacacgttgtccaatttcaatcatagcaaaatgaggattataccaaaaaaaagtaataatgagttcaggattattgccatcccatgcagaggggcagacgaagaagaattcacaatttataaggagaatcacaaaaatgctatccagcccactcaaaaaattttagaatacctaagaaacaaaaggccgactagttttactaaaatatattctccaacgcaaatagctgaccgtatcaaagaatttaagcagagacttttaaagaaatttaataatgtcttaccagagctttatttcatgaaatttgatgtcaaatcttgctatgattccataccaaggatggaatgtatgaggatactcaaggatgcgctaaaaaatgaaaatgggtttttcgttagatctcaatatttcttcaataccaatacaggtgtattgaagttatttaatgttgttaacgctagcagagtaccaaaaccttatgagctatacatagataatgtgaggacggttcatttatcaaatcaggatgttataaacgttgtagagatggaaatatttaaaacagctttgtgggttgaagataagtgctacattagagaagatggtctttttcagggctctagtttatctgctccgatcgttgatttggtgtatgacgatcttctggagttttatagcgagtttaaagccagtcctagccaggacacattaattttaaaactggctgacgatttccttataatatcaacagaccaacagcaagtgatcaatatcaaaaagcttgccatgggcggatttcaaaaatataatgcgaaagccaatagagacaaaattttagccgtaagctcccaatcagatgatgatacggttattcaattttgtgcaatgcacatatttgttaaagaattggaagtttggaaacattcaagcacaatgaataatttccatatccgttcgaaatctagtaaagggatatttcgaagtttaatagcgctgtttaacactagaatctcttataaaacaattgacacaaatttaaattcaacaaacaccgttctcatgcaaattgatcatgttgtaaagaacatttcggaatgttataaatctgcttttaaggatctatcaattaatgttacgcaaaatatgcaatttcattcgttcttacaacgcatcattgaaatgacagtcagcggttgtccaattacgaaatgtgatcctttaatcgagtatgaggtacgattcaccatattgaatggatttttggaaagcctatcttcaaacacatcaaaatttaaagataatatcattcttttgagaaaggaaattcaacacttgcaagc

SEQ ID NO: 226 - protein, 157 aa
FFYCTEISSTVTIVYFRHDTWNKLITPFIVEYFKTYLVENNVCRNHNSYTLSNFNHSKMRIIPKKSNNEFRIIAIPCRGADEEEFTIYKENHKNAIQPTQKILEYLRNKRPTSFTKIYSPTQIADRIKEFKQRLLKKFNNVLPELYFMKFDVKSCYD

SEQ ID NO: 227 - protein, 155 aa
FFYVTEQQKSYSKTYYYRKNIWDVIMKMSIADLKKETLAEVQEKEVEEWKKSLGFAPGKLRLIPKKTTFRPIMTFNKKIVNSDRKTTKLTTNTKLLNSHLMLKTLKNRMFKDPFGFAVFNYDDVMKKYEEFVCKWKQVGQPKLFFATMDIEKCYD

SEQ ID NO: 228 - protein, 158 aa
KHKEGSQIFYYRKPIWKLVSKLTIVKVRIQFSEKNKQMKNNFYQKIQLEEENLEKVEEKLIPEDSFQKYPQGKLRIIPKKGSFRPIMTFLRKDKQKNIKLNLNQILMDSQLVFRNLKDMLGQKIGYSVFDNKQISEKFAQFIEKWKNKGRPQLYYVTL

SEQ ID NO: 229 - protein, 5 aa
YYYRK

SEQ ID NO: 230 - protein, 9 aa
GKLRIIPKK

SEQ ID NO: 231 - protein, 7 aa
FRPIMTF

SEQ ID NO: 232 - protein, 24 aa
FFYVTETTFQKNRLFFYRKSVWSK

SEQ ID NO: 233 - protein, 23 aa
RQHLKRVQLRDVSEAEVRQHREA

SEQ ID NO: 234 - protein, 27 aa
ARTFRREKRAERLTSRVKALFSVLNYE

SEQ ID NO: 235 - protein, 28 aa
AKFLHWLMSVYVVELLRSFFYVTETTFQ

SEQ ID NO: 236 - protein, 30 aa
LFFYRKSVWSKLQSIGIRQHLKRVQLRDVS

SEQ ID NO: 237 - protein, 27 aa
PALLTSRLRFIPKPDGLRPIVNMDYVV

SEQ ID NO: 238 - DNA, 23 bp; single-stranded, linear
yarachaargghatycchyargg

SEQ ID NO: 239 - protein, 8 aa
QTKGIPQG

SEQ ID NO: 240 - protein, 7 aa
DDYLLIT

SEQ ID NO: 241 - DNA, 21 bp; single-stranded, linear
ngtnatdardarrtartcrtc

SEQ ID NO: 242 - protein, 55 aa
KGIPQGLCVSSILSSFYYATLEESSLGFLRDESMNPENPNVNLLMRLTDDYLLIT

SEQ ID NO: 243 - protein, 34 aa
SILSSFLCHFYMEDLIDEYLSFTKKKGSVLLRVV

SEQ ID NO: 244 - protein, 49 aa
DGLFQGSSLSAPIVDLVYDDLLEFYSEFKASPSQDTLILKLADDFLIIS

SEQ ID NO: 245 - protein, 8 aa
QKVGIPQG

SEQ ID NO: 246 - DNA (genomic), 23 bp; single-stranded, linear
caaaaagttggtatccctcaggg

SEQ ID NO: 247 - DNA (genomic), 146 bp; single-stranded, linear
agaccaaaggaattccatcaggctcaattctgtcatcttttttgtgtcatttctatatggaagatttgattgatgaatacctatcgtttacgaaaaagaaaggatcagtgttgttacgagtagtcgacgactacctcctcatcacc

SEQ ID NO: 248 - protein, 47 aa
KGIPSGSILSSFLCHFYMEDLIDEYLSFTKKKGSVLLRVVDDYLLIT

SEQ ID NO: 249 - DNA (genomic), 21 bp; single-stranded, linear
gacgatttcctctttataaca

SEQ ID NO: 250 - protein, 7 aa
DDFLFIT

SEQ ID NO: 251 - protein, 35 aa
  Peptide 1..35: /note= "motif 0 peptide from Schizosaccharomyces pombe tez1p"
WLYNSFIIPILQSFFYITESSDLRNRTVYFRKDIW

SEQ ID NO: 252 - protein, 22 aa
  Peptide 1..22: /note= "motif 1 and 2 peptide from Schizosaccharomyces pombe tez1p"
AVIRLLPKKNTFRLITNLRKRF

SEQ ID NO: 253 - protein, 26 aa
  Peptide 1..26: /note= "motif 3(A) peptide from Schizosaccharomyces pombe tez1p"
KKYFVRIDIKSCYDRIKQDLMFRIVK

SEQ ID NO: 254 - protein, 32 aa
  Peptide 1..32: /note= "motif 4(B') peptide from Schizosaccharomyces pombe tez1p"
YLQKVGIPQGSILSSFLCHFYMEDLIDEYLSF

SEQ ID NO: 255 - protein, 49 aa
  Peptide 1..49: /note= "motif 5(C) and 6(D) peptide from Schizosaccharomyces pombe tez1p"
VLLRVVDDFLFITVNKKDAKKFLNLSLRGFEKHNFSTSLEKTVINFENS

SEQ ID NO: 256 - protein, 34 aa
  Peptide 1..34: /note= "motif 0 peptide from Saccharomyces cerevisiae EST2p"
WLFRQLIPKIIQTFFYCTEISSTVTIVYFRHDTW

SEQ ID NO: 257 - protein, 25 aa
  Peptide 1..25: /note= "motif 1 and 2 peptide from Saccharomyces cerevisiae EST2p"
SKMRIIPKKSNNEFRIIAIPCRGAD

SEQ ID NO: 258 - protein, 26 aa
  Peptide 1..26: /note= "motif 3(A) peptide from Saccharomyces cerevisiae EST2p"
ELYFMKFDVKSCYDSIPRMECMRILK

SEQ ID NO: 259 - protein, 32 aa
  Peptide 1..32: /note= "motif 4(B') peptide from Saccharomyces cerevisiae EST2p"
YIREDGLFQGSSLSAPIVDLVYDDLLEFYSEF

SEQ ID NO: 260 - protein, 49 aa
  Peptide 1..49: /note= "motif 5(C) peptide from Saccharomyces cerevisiae EST2p"
LILKLADDFLIISTDQQQVINIKKLAMGGFQKYNAKANRDKILAVSSQS

SEQ ID NO: 261 - protein, 35 aa
  Peptide 1..35: /note= "motif 0 peptide from Euplotes aediculatus p123"
WIFEDLVVSLIRCFFYVTEQQKSYSKTYYYRKNIW

SEQ ID NO: 262 - protein, 23 aa
  Peptide 1..23: /note= "motif 1 and 2 peptide from Euplotes aediculatus p123"
GKLRLIPKKTTFRPIMTFNKKIV

SEQ ID NO: 263 - protein, 26 aa
  Peptide 1..26: /note= "motif 3(A) peptide from Euplotes aediculatus p123"
KLFFATMDIEKCYDSVNREKLSTFLK

SEQ ID NO: 264 - protein, 32 aa
  Peptide 1..32: /note= "motif 4(B') peptide from Euplotes aediculatus p123"
YKQTKGIPQGLCVSSILSSFYYATLEESSLGF

SEQ ID NO: 265 - protein, 49 aa
  Peptide 1..49: /note= "motif 5(C) and 6(D) peptide from Euplotes aediculatus p123"
LLMRLTDDYLLITTQENNAVLFIEKLINVSRENGFKFNMKKLQTSFPLS

SEQ ID NO: 266 - DNA (genomic), 2171 bp; single-stranded, linear
  CDS 22..1716: /note= "EcoRI-NotI insert of clone 712562 encoding 63 kDa telomerase protein"
gccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagarggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaacccacatttttcctgcgcgtcatctctgacacggctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggcttatacgtcccagggagggaggggcggcccacacccaggcctgcaccgctgggagtctgaggcctgagtgagtgtttggccgaggcctgcatgtccggctgaaggctgagtgtccggctgaggcctgagcgagtgtccagccaagggctgagtgtccagcacacctgcgttttcacttccccacaggctggcgttcggtccaccccagggccagcttttcctcaccaggagcccggcttccactccccacataggaatagtccatccccagattcgccattgttcacccttcgccctgccttcctttgccttccacccccaccattcaggtggagaccctgagaaggaccctgggagctttgggaatttggagtgaccaaaggtgtgccctgtacacaggcgaggaccctgcacctggatgggggtccctgtgggtcaaattggggggaggtgctgtgggagtaaaatactgaatatatgagtttttcagttttggaaaaaaaaaaaaaaaaaaaaaaaaaa

SEQ ID NO: 267 - protein, 564 aa
  Protein 1..564: /note= "63 kDa telomerase protein encoded by ORF of EcoRI-NotI insert of clone 712562"
MSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKXAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAMGTSARPSRATSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPHFSCASSLTRLPLLLHPESQERRDVAGGQGRRRPSALRGRAVAVPPSIPAQADSTPCHLRATPGVTQDSPDAAESEAPGDDADCPGGRSQPGTALRLQDHPGLMATRPQPGREQTPAALSRRAYTSQGGRGGPHPGLHRWESEA

SEQ ID NO: 268 - protein, 22 aa
  Peptide 1..22: /note= "motif 1 peptide from Euplotes aediculatus p123"
LVVSLIRCFFYVTEQQKSYSKT

SEQ ID NO: 269 - protein, 30 aa
  Peptide 1..30: /note= "motif 0 peptide from Euplotes aediculatus p123"
KSLGFAPGKLRLIPKKTTFRPIMTFNKKIV

SEQ ID NO: 270 - protein, 27 aa
  Peptide 1..27: /note= "motif A peptide from Euplotes aediculatus p123"
PKLFFATMDIEKCYDSVNREKLSTFLK

SEQ ID NO: 271 - protein, 27 aa
  Peptide 1..27: /note= "motif B peptide from Euplotes aediculatus p123"
NGKFYKQTKGIPQGLCVSSILSSFYYA

SEQ ID NO: 272 - protein, 22 aa
  Peptide 22: /note= "motif C peptide from Euplotes aediculatus p123"
PNVNLLMRLTDDYLLITTQENN

SEQ ID NO: 273 - protein, 15 aa
  Peptide 1..15: /note= "motif D peptide from Euplotes aediculatus p123"
NVSRENGFKFNMKKL

SEQ ID NO: 274 - protein, 22 aa
  Peptide 1..22: /note= "motif 1 peptide from Schizosaccharomyces pombe tez1"
FIIPILQSFFYITESSDLRNRT

SEQ ID NO: 275 - protein, 30 aa
  Peptide 1..30: /note= "motif 0 peptide from Schizosaccharomyces pombe tez1"
QKTTLPPAVIRLLPKKNTFRLITNLRKRFL

SEQ ID NO: 276 - protein, 27 aa
  Peptide 1..27: /note= "motif A peptide from Schizosaccharomyces pombe tez1"
RKKYFVRIDIKSCYDRIKQDLMFRIVK

SEQ ID NO: 277 - protein, 27 aa
  Peptide 1..27: /note= "motif B peptide from Schizosaccharomyces pombe tez1"
GNSQYLQKVGIPQGSILSSFLCHFYME

SEQ ID NO: 278 - protein, 22 aa
  Peptide 1..22: /note= "motif C peptide from Schizosaccharomyces pombe tez1"
KKGSVLLRVVDDFLFITVNKKD

SEQ ID NO: 279 - protein, 15 aa
  Peptide 1..15: /note= "motif D peptide from Schizosaccharomyces pombe tez1"
LNLSLRGFEKHNFST

SEQ ID NO: 280 - protein, 22 aa
  Peptide 1..22: /note= "motif 1 peptide from Saccharomyces cerevisiae EST2"
LIPKIIQTFFYCTEISSTVTIV

SEQ ID NO: 281 - protein, 32 aa
  Peptide 1..32: /note= "motif 0 peptide from Saccharomyces cerevisiae EST2"
TLSNFNHSKMRIIPKKSNNEFRIIAIPCRGAD

SEQ ID NO: 282 - protein, 27 aa
  Peptide 1..27: /note= "motif A peptide from Saccharomyces cerevisiae EST2"
PELYFMKFDVKSCYDSIPRMECMRILK

SEQ ID NO: 283 - protein, 27 aa
  Peptide 1..27: /note= "motif B peptide from Saccharomyces cerevisiae EST2"
EDKCYIREDGLFQGSSLSAPIVDLVYD

SEQ ID NO: 284 - protein, 22 aa
  Peptide 1..22: /note= "motif C peptide from Saccharomyces cerevisiae EST2"
SQDTLILKLADDFLIISTDQQQ

SEQ ID NO: 285 - protein, 15 aa
  Peptide 1..15: /note= "motif D peptide from Saccharomyces cerevisiae EST2"
KKLAMGGFQKYNAKA

SEQ ID NO: 286 - protein, 22 aa
  Peptide 1..22: /note= "motif 1 peptide from human telomerase core protein 1 (TCP1)"
YVVELLRSFFYVTETTFQKNRL

SEQ ID NO: 287 - protein, 30 aa
  Peptide 1..30: /note= "motif 0 peptide from human telomerase core protein 1 (TCP1)"
ARPALLTSRLRFIPKPDGLRPIVNMDYVVG

SEQ ID NO: 288 - protein, 27 aa
  Peptide 1..27: /note= "motif A peptide from human telomerase core protein 1 (TCP1)"
PELYFVKVDVTGAYDTIPQDRLTEVIA

SEQ ID NO: 289 - protein, 27 aa
  Protein 1..27: /note= "motif B peptide from human telomerase core protein 1 (TCP1)"
RATSYVQCQGIPQGSILSTLLCSLCYG

SEQ ID NO: 290 - protein, 22 aa
  Peptide 1..22: /note= "motif C peptide from human telomerase core protein 1 (TCP1)"
RRDGLLLRLVDDFLLVTPHLTH

SEQ ID NO: 291 - protein, 15 aa
  Peptide 1..15: /note= "motif D peptide from human telomerase core protein 1 (TCP1)"
LRTLVRGVPEYGCVV

SEQ ID NO: 292 - DNA (cDNA), 4029 bp; single-stranded, linear
  - 1..4029: /note= "preliminary sequence for human TRT cDNA insert of plasmid pGRN121"
gcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgntggtggcccantgcntggtgtgcgtgccctgggangnanggcngccccccgccgccccctccttccgccaggtgtcctgcctgaanganctggtggcccgagtgctgcanangctgtgcgancgcggcgcgaanaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgntntttgtgctggtggntcccagctgcgcctaccangtgtgcgggccgccgctgtaccagctcggcgctgcnactcaggcccggcccccgccacacgctantggacccgaangcgtctgggatccaacgggcctggaaccatagcgtcagggaggccggggtccccctgggctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcctggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtcctgggacacgccttgtcccccggtgtacgccgagaccaagcacttcctctactcctcaggcgacaagnacactgcgnccctccttcctactcaatatatctgaggcccagcctgactggcgttcgggaggttcgtggagacantctttctggttccaggccttggatgccaggattccccgcaggttgccccgcctgccccagcgntactggcaaatgcggcccctgtttctggagctgcttgggaaccacgcgcagtgcccctacggggtgttcctcaagacgcactgcccgctgcgagctgcggtcaccccagcagccggtgtctgtgcccgggagaagccccagggctctgtggcggcccccgaggaggaggaacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcagganaacagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaaaaaaaaaa

SEQ ID NO: 293 - protein, 261 aa
AALRPAAHVGSPGPGHPRDAARSPLPSRALPAAQPLPRGAAAGHVRAAPGAPGLAAGAARGPGGFPRXGGPXXGVRALGXXAAPRRPLLPPGVLPEXXGGPSAAXAVRXRREXRAGLRLRAAGRGPRGPPRGLHHQRAQLPAQHGDRRTAGERGVGAAAAPRGRRRAGSPAGTLRXXCAGGSQLRLPXVRAAAVPARRCXSGPAPATRXWTRXRLGSNGPGTIASGRPGSPWAASPGCEEARGQCQPKSAVAQEAQAWRCP

SEQ ID NO: 294 - protein, 21 aa
AGADARWAGVLGPPGQDAWTE

SEQ ID NO: 295 - protein, 82 aa
PWFLCGVTCQTRRRSHLFGGCALWHAPLPPIRGPPAPRGPPIHIAATTSWDTPCPPVYAETKHFLYSSGDKXTAXLLPTQYI

SEQ ID NO: 296 - protein, 153 aa
LAFGRFVETXFLVPGLGCQDSPQVAPPAPAXLANAAPVSGAAWEPRAVPLRGVPQDALPAASCGHPSSRCLCPGEAPGLCGGPRGGGTQTPVAWCSCSASTAAPGRCTASCGPACAGWCPQASGAPGTTNAASSGTPRSSSPWGSMPSSRCRS

SEQ ID NO: 297 - protein, 35 aa
ACGTALGCAGAQGLAVFRPQSTVCVRRSWPSSCTG

SEQ ID NO: 298 - protein, 43 aa
VCTSSSCSGLSFMSRRPRFKRTGSFSTGRVSGASCKALESDST

SEQ ID NO: 299 - protein, 23 aa
RGCSCGSCRKQRSGSIGKPGPPC

SEQ ID NO: 300 - protein, 16 aa
RPDSASSPSLTGCGRL

SEQ ID NO: 301 - protein, 23 aa
TWTTSWEPERSAEKRGPSVSPRG

SEQ ID NO: 302 - protein, 54 aa
RHCSACSTTSGRGAPASWAPLCWAWTISTGPGAPSCCVCGPRTRRLSCTLSRWM

SEQ ID NO: 303 - protein, 52 aa
RARTTPSPRTGSRRSSPASSNPRTRTACVGMPWSRRPPMGTSARPSRATSLP

SEQ ID NO: 304 - protein, 19 aa
QTSSRTCDSSWLTCRXTAR

SEQ ID NO: 305 - protein, 11 aa
GMPSSSSRAPP

SEQ ID NO: 306 - protein, 74 aa
MRPAVASSTSSYASCATTPCASGASPTSSARGSRRAPSSPRCSAACATATWRTSCLRGFGGTGCSCVWWMISCW

SEQ ID NO: 307 - protein, 24 aa
HLTSPTRKPSSGPWSEVSLSMAAW

SEQ ID NO: 308 - protein, 6 aa
TCGRQW

SEQ ID NO: 309 - protein, 70 aa
KTRPWVARLLFRCRPTAYSPGAACCWIPGPWRCRATTPAMPGPPSEPVSPSTAASRLGGTCVANSLGSCG

SEQ ID NO: 310 - protein, 10 aa
SVTACFWICR

SEQ ID NO: 311 - protein, 55 aa
TASRRCAPTSTRSSCCRRTGFTHVCCSSHFISKFGRTPHFSCASSLTRPPSATPS

SEQ ID NO: 312 - protein, 34 aa
KPRTQGCRWGPRAPPALCPPRPCSGCATKHSCSS

SEQ ID NO: 313 - protein, 20 aa
LDTVSPTCHSWGHSGQPRRS

SEQ ID NO: 314 - protein, 8 aa
VGSSRGRR

SEQ ID NO: 315 - protein, 61 aa
LPWRPQPTRHCPQTSRPSWTDGHPPTARPRADTSSPVTPGSTSQGGRGGPHPGPHRWESEA

SEQ ID NO: 316 - protein, 13 aa
VSVWPRPACPAEG

SEQ ID NO: 317 - protein, 9 aa
GLSECPAKG

SEQ ID NO: 318 - protein, 34 aa
VSSTPAVFTSPQAGARLHPRASFSSPGARLPLPT

SEQ ID NO: 319 - protein, 70 aa
SIPRFAIVHPSPCPPLPSTPTIQVETLRRTLGALGIWSDQRCALYTGEDPAPGWGSLWVKLGGGAVGVKY

SEQ ID NO: 320 - protein, 16 aa
IYEFFSFEKKKKKKKK

SEQ ID NO: 321 - protein, 222 aa
QRCVLLRTWEALAPATPAMPRAPRCRAVRSLLRSHYREVLPLATFVRRLGPQGWRLVQRGDPAAFRAXVAXCXVCVPWXXXXPPAAPSFRQVSCLXXLVARVLXXLCXRGAXNVLAFGFALLDGARGGPPEAFTTSVRSYLPNTVTDALRGSGAWGLLLRRVGDDVLVHLLARCAXFVLVXPSCAYXVCGPPLYQLGAATQARPPPHAXGPEXVWDPTGLEP

SEQ ID NO: 322 - protein, 330 aa
RQGGRGPPGLPAPGARRRGGSASRSLPLPKRPRRGAAPEPERTPVGQGSWAHPGRTPGPSDRGFCVVSPARPAEEATSLEGALSGTRHSHPSVGRQHHAGPPSTSRPPRPGTRLVPRCTPRPSTSSTPQATXTLRPSFLLNISEAQPDWRSGGSWRXSFWFQALDARIPRRLPRLPQRYWQMRPLFLELLGNHAQCPYGVFLKTHCPLRAAVTPAAGVCAREKPQGSVAAPEEEEHRPPSPGAAAPPAQQPLAGVRLRAGLPAPAGAPRPLGLQAQRTPLPQEHQEVHLPGEACQALAAGADVEDERAGLRLAAQEPRGWLCSGRRAPSA

SEQ ID NO: 323 - protein, 89 aa
GDPGQVPALADECVRRRAAQVFLLCHGDHVSKEQALFLPEECLEQVAKHWNQTALEEGAAAGAVGSRGQAASGSQARPADVQTPLHPQA

SEQ ID NO: 324 - protein, 76 aa
RAAADCEHGLRRGSQNVPQRKEGRASHLEGEGTVQRAQLRAGAAPRPPGRLCAGPGRYPQGLAHLRAACAGPGPAA

SEQ ID NO: 325 - protein, 94 aa
AVLCQGGCDGRVRHHPPGQAHGGHRQHHQTPEHVLRASVCRGPEGRPWARPQGLQEPRLYLDRPPAVHATVRGSPAGXQPAEGCRRHRAELLPE

SEQ ID NO: 326 - protein, 68 aa
GQQWPLRRLPTLHVPPRRAHQGQVLRPVPGDPAGLHPLHAALQPVLRRHGEQAVCGDSAGRAAPAFGG

SEQ ID NO: 327 - protein, 23 aa
FLVGDTSPHPRENLPQDPGPRCP

SEQ ID NO: 328 - protein, 144 aa
VWLRGELAEDSGELPCRRRGPGWHGFCSDAGPRPIPLVRPAAGYPDPGGAERLLQLCPDLHQSQSHLQPRLQGWEEHASQTLWGLAAEVSQPVSGFAGEQPPDGVHQHLQDPPAAGVQVSRMCAAAPISSASLEEPHIFPARHL

SEQ ID NO: 329 - protein, 137 aa
HGLPLLLHPESQERRDVAGGQGRRRPSALRGRAVAVPPSIPAQADSTPCHLRATPGVTQDSPDAAESEAPGDDADCPGGRSQPGTALRLQDHPGLMATRPQPGREQTPAALSRRALRPREGGAAHTQARTAGSLRPE

SEQ ID NO: 330 - protein, 18 aa
VFGRGLHVRLKAECPAEA

SEQ ID NO: 331 - protein, 71 aa
ASVQPRAECPAHLPSSLPHRLALGSTPGPAFPHQEPGFHSPHRNSPSPDSPLFTPRPALLCLPPPPSRWRP

SEQ ID NO: 332 - protein, 40 aa
EGPWELWEFGVTKGVPCTQARTLHLDGGPCGSNWGEVLWE

SEQ ID NO: 333 - protein, 18 aa
NTEYMSFSVLKKKKKKKK

SEQ ID NO: 334 - protein, 94 aa
SAASCCARGKPWPRPPPRCRALPAAEPCAPCCAATTARCCRWPRSCGAWGPRAGGWCSAGTRRLSARWWPXAWCACPGXXGXPPPPPPSARCPA

SEQ ID NO: 335 - protein, 49 aa
XXWWPECCXXCAXAARXTCWPSASRCWTGPAGAPPRPSPPACAATCPTR

SEQ ID NO: 336 - protein, 1003 aa
PTHCGGAGRGGCCCAAWATTCWFTCWHAARXLCWWXPAAPTXCAGRRCTSSALXLRPGPRHTLXDPXASGIQRAWNHSVREAGVPLGCQPRVRGGAGAVPAEVCRCPRGPGVALPLSRSGRPLGRGPGPTRAGRLDRVTVVSVWCHLPDPPKKPPLWRVRSLARATPTHPWAASTTRAPHPHRGHHVLGHALSPGVRRDQALPLLLRRQXHCXPPSYSIYLRPSLTGVREVRGDXLSGSRPWMPGFPAGCPACPSXTGKCGPCFWSCLGTTRSAPTGCSSRRTARCELRSPQQPVSVPGRSPRALWRPPRRRNTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQXNSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 337 - protein, 38 aa
WPPAHSQAESRHQQPCHAGLYVPGREGRPTPRPAPLGV

SEQ ID NO: 338 - protein, 13 aa
GLSECLAEACMSG

SEQ ID NO: 339 - protein, 91 aa
RLSVRLRPERVSSQGLSVQHTCRLHFPTGWRSAPPQGQLFLTRSPASTPHIGIVHPQIRHCSPLALPSFAFHPHHPGGDPEKDPGSSGNLE

SEQ ID NO: 340 - protein, 34 aa
PKVCPVHRRGPCTWMGVPVGQIGGRCCGSKILNI

SEQ ID NO: 341 - protein, 4 aa
VFQF

SEQ ID NO: 342 - protein, 8 aa
KKKKKKKK

SEQ ID NO: 343 - DNA (cDNA), 4037 bp; single-stranded, linear
  CDS 56..3454: /note= "refined sequence of hTRT cDNA"
gcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggccgagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtgtcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcytcaccaggagcccggcttccactccccacataggaatagtccatccccagattcgccattgttcacccytcgccctgccytcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgraaaaaaaaaaaaaaaaaaaaaaaaaaaa

SEQ ID NO: 344 - protein, 1132 aa
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRPSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASVTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 345 - protein, 5 aa
  Modified-site 1: /product= "OTHER" /note= "Xaa = hydrophobic amino acid, Ala, Leu, Ile, Val, Pro, Phe, Trp or Met"
  Modified-site 5: /product= "OTHER" /note= "Xaa = Phe or Tyr"
XXDDX

SEQ ID NO: 346 - protein, 5 aa
  Modified-site 1: /product= "OTHER" /note= "Xaa = Phe or Tyr"
  Modified-site 5: /product= "OTHER" /note= "Xaa = hydrophobic amino acid, Ala, Leu, Ile, Val, Pro, Phe, Trp or Met"
XXDDX

SEQ ID NO: 347 - protein, 6 aa
WXGXSX

SEQ ID NO: 348 - protein, 6 aa
  Modified-site 1: /product= "OTHER" /note= "Xaa = hydrophobic amino acid, Ala, Leu, Ile, Val, Pro, Phe, Trp or Met"
  Modified-site 6: /product= "OTHER" /note= "Xaa = hydrophobic amino acid, Ala, Leu, Ile, Val, Pro, Phe, Trp or Met"
XLGXXX

SEQ ID NO: 349 - protein, 33 aa
  Modified-site 7..8: /product= "OTHER" /note= "Xaa = hydrophobic amino acid, Ala, Leu, Ile, Val, Pro, Phe, Trp or Met"
  Modified-site 10..11: /product= "OTHER" /note= "Xaa = hydrophobic amino acid, Ala, Leu, Ile, Val, Pro, Phe, Trp or Met"
  Modified-site 13: /product= "OTHER" /note= "Xaa = polar amino acid, Gly, Ser, Thr, Tyr, Cys, Asn or Gln"
  Modified-site 19: /product= "OTHER" /note= "Xaa = polar amino acid, Gly, Ser, Thr, Tyr, Cys, Asn or Gln"
  Modified-site 23: /product= "OTHER" /note= "Xaa = polar amino acid, Gly, Ser, Thr, Tyr, Cys, Asn or Gln"
WLXYXXXXXXXXXFFTEXXXXXXXXXYXRKXXW

SEQ ID NO: 350 - protein, 34 aa
  Modified-site 2: /product= "OTHER" /note= "Xaa = Leu or Ile"
  Modified-site 7..8: /product= "OTHER" /note= "Xaa = hydrophobic amino acid, Ala, Leu, Ile, Val, Pro, Phe, Trp or Met"
  Modified-site 10..11: /product= "OTHER" /note= "Xaa = hydrophobic amino acid, Ala, Leu, Ile, Val, Pro, Phe, Trp or Met"
  Modified-site 12: /product= "OTHER" /note= "Xaa = Gln or Arg"
  Modified-site 13: /product= "OTHER" /note= "Xaa = polar amino acid, Gly, Ser, Thr, Tyr, Cys, Asn or Gln"
  Modified-site 21: /product= "OTHER" /note= "Xaa = polar amino acid, Gly, Ser, Thr, Tyr, Cys, Asn or Gln"
  Modified-site 25: /product= "OTHER" /note= "Xaa = polar amino acid, Gly, Ser, Thr, Tyr, Cys, Asn or Gln"
  Modified-site 28..29: /product= "OTHER" /note= "Xaa = Phe or Tyr"
  Modified-site 31: /product= "OTHER" /note= "Xaa = Lys or His"
WXXXXXXXXXXXXFFYXTEXXXXXXXXXXRXXXW

SEQ ID NO: 351 - protein, 35 aa
  Modified-site 2: /product= "OTHER" /note= "Xaa = Leu or Ile"
  Modified-site 7..8: /product= "OTHER" /note= "Xaa = hydrophobic amino acid, Ala, Leu, Ile, Val, Pro, Phe, Trp or Met"
  Modified-site 10..11: /product= "OTHER" /note= "Xaa = hydrophobic amino acid, Ala, Leu, Ile, Val, Pro, Phe, Trp or Met"
  Modified-site 12: /product= "OTHER" /note= "Xaa = Gln or Arg"
  Modified-site 13: /product= "OTHER" /note= "Xaa = polar amino acid, Gly, Ser, Thr, Tyr, Cys, Asn or Gln"
  Modified-site 21: /product= "OTHER" /note= "Xaa = polar amino acid, Gly, Ser, Thr, Tyr, Cys, Asn or Gln"
  Modified-site 25: /product= "OTHER" /note= "Xaa = polar amino acid, Gly, Ser, Thr, Tyr, Cys, Asn or Gln"
  Modified-site 29..30: /product= "OTHER" /note= "Xaa = Phe or Tyr"
  Modified-site 32: /product= "OTHER" /note= "Xaa = Lys or His"
WXXXXXXXXXXXXFFYXTEXXXXXXXXXXXRXXXW

SEQ ID NO: 352 - protein, 42 aa
WXXXXXXXXXXXXFFYXTEXXXXXXXXXXRXXXWXXXXXXXI

SEQ ID NO: 353 - protein, 43 aa
WXXXXXXXXXXXXFFYXTEXXXXXXXXXXXRXXXWXXXXXXXI

SEQ ID NO: 354 - protein, 5 aa
EXXVX

SEQ ID NO: 355 - protein, 11 aa
XXXRXXPKXXX

SEQ ID NO: 356 - protein, 5 aa
XRXIX

SEQ ID NO: 357 - protein, 17 aa
XXXXFXXXDXXXXYDXX

SEQ ID NO: 358 - protein, 22 aa
YXXXXGXXQGXXXSXXXXXXXX

SEQ ID NO: 359 - protein, 13 aa
XXXXXXDDXLXXX

SEQ ID NO: 360 - protein, 6 aa
FFYXTE

SEQ ID NO: 361 - protein, 6 aa
FFYVTE

SEQ ID NO: 362 - DNA, 17 bp; single-stranded, linear
ttyttytaygtnacnga

SEQ ID NO: 363 - DNA, 17 bp; single-stranded, linear
tcngtnacrtaraaraa

SEQ ID NO: 364 - protein, 6 aa
RFIPKP

SEQ ID NO: 365 - DNA, 17 bp; single-stranded, linear
mgnttyathccnaarcc

SEQ ID NO: 366 - DNA, 16 bp; single-stranded, linear
ggyttnggdatraanc

SEQ ID NO: 367 - protein, 5 aa
AYDTI

SEQ ID NO: 368 - DNA, 14 bp; single-stranded, linear
gcntaygayacnat

SEQ ID NO: 369 - DNA, 14 bp; single-stranded, linear
tangtrtcrtangc

SEQ ID NO: 370 - protein, 5 aa
GIPQG

SEQ ID NO: 371 - DNA, 14 bp; single-stranded, linear
ggnathccncargg

SEQ ID NO: 372 - DNA, 17 bp; single-stranded, linear
swnccytgnggdatncc

SEQ ID NO: 373 - protein, 6 aa
LVDDFL

SEQ ID NO: 374 - DNA, 17 bp; single-stranded, linear
ytngtngaygayttyyt

SEQ ID NO: 375 - protein, 7 aa
DDFLLVT

SEQ ID NO: 376 - DNA, 20 bp; single-stranded, linear
gtnacnarnarraartcrtc

SEQ ID NO: 377 - DNA, 19 bp; single-stranded, linear
  - 1..19: /note= "TCP1.1 primer"
gtgaaggcactgttcagcg

SEQ ID NO: 378 - DNA, 20 bp; single-stranded, linear
  - 1..20: /note= "TCP1.15 primer"
cgcgtgggtgaggtgaggtg

SEQ ID NO: 379 - DNA, 21 bp; single-stranded, linear
  - 1..21: /note= "TCP1.14 primer"
ctgtgctgggcctggacgata

SEQ ID NO: 380 - DNA, 24 bp; single-stranded, linear
  - 1..24: /note= "billTCP6 primer"
agcttgttctccatgtcgccgtag

SEQ ID NO: 381 - DNA, 19 bp; single-stranded, linear
  - 1..19: /note= "TCP1.2 primer"
gtggatgatttcttgttgg

SEQ ID NO: 382 - DNA, 19 bp; single-stranded, linear
  - 1..19: /note= "TCP1.4 primer"
ctggacactcagcccttgg

SEQ ID NO: 383 - DNA, 19 bp; single-stranded, linear
  - 1..19: /note= "TCP1.5 primer"
ggcaggtgtgctggacact

SEQ ID NO: 384 - DNA, 19 bp; single-stranded, linear
  - 1..19: /note= "TCP1.6 primer"
tttgatgatgctggcgatg

SEQ ID NO: 385 - DNA, 19 bp; single-stranded, linear
  - 1..19: /note= "TCP1.7 primer"
ggggctcgtcttctacagg

SEQ ID NO: 386 - DNA, 19 bp; single-stranded, linear
  - 1..19: /note= "TCP1.8 primer"
cagcaggaggatcttgtag

SEQ ID NO: 387 - DNA, 19 bp; single-stranded, linear
  - 1..19: /note= "TCP1.9 primer"
tgaccccaggagtggcacg

SEQ ID NO: 388 - DNA, 19 bp; single-stranded, linear
  - 1..19: /note= "TCP1.10 primer"
tcaagctgactcgacaccg

SEQ ID NO: 389 - DNA, 17 bp; single-stranded, linear
  - 1..17: /note= "TCP1.11 primer"
cggcgtgacagggctgc

SEQ ID NO: 390 - DNA, 18 bp; single-stranded, linear
  - 1..18: /note= "TCP1.12 primer"
gctgaaggctgagtgtcc

SEQ ID NO: 391 - DNA, 19 bp; single-stranded, linear
  - 1..19: /note= "TCP1.13 primer"
tagtccatgttcacaatcg

SEQ ID NO: 392 - DNA, 19 bp; single-stranded, linear
  - 1..19: /note= "TCP1.16 primer"
tttccgtgttgagtgtttc

SEQ ID NO: 393 - DNA, 18 bp; single-stranded, linear
  - 1..18: /note= "TCP1.17 primer"
gtcaccgtgttgggcagg

SEQ ID NO: 394 - DNA, 18 bp; single-stranded, linear
  - 1..18: /note= "TCP1.19 primer"
gctacctgcccaacacgg

SEQ ID NO: 395 - DNA, 18 bp; single-stranded, linear
  - 1..18: /note= "TCP1.20 primer"
gcgcgaagaacgtgctgg

SEQ ID NO: 396 - DNA, 19 bp; single-stranded, linear
  - 1..19: /note= "TCP1.21 primer"
cactgctccttgtcgcctg

SEQ ID NO: 397 - DNA, 19 bp; single-stranded, linear
  - 1..19: /note= "TCP1.22 primer"
ttcccaaggactttgttgc

SEQ ID NO: 398 - DNA, 19 bp; single-stranded, linear
  - 1..19: /note= "TCP1.24 primer"
tgttcctcaagacgcactg

SEQ ID NO: 399 - DNA, 19 bp; single-stranded, linear
  - 1..19: /note= "TCP1.25 primer"
tactgcgtgcgtcggtatg

SEQ ID NO: 400 - DNA, 19 bp; single-stranded, linear
  - 1..19: /note= "TCP1.26 primer"
ggtcttgcggctgaagtgt

SEQ ID NO: 401 - DNA, 19 bp; single-stranded, linear
  - 1..19: /note= "TCP1.27 primer"
tggttcacctgctggcacg

SEQ ID NO: 402 - DNA, 19 bp; single-stranded, linear
  - 1..19: /note= "TCP1.28 primer"
gtggtttctgtgtggtgtc

SEQ ID NO: 403 - DNA, 19 bp; single-stranded, linear
  - 1..19: /note= "TCP1.29 primer"
gacaccacacagaaaccac

SEQ ID NO: 404 - DNA, 19 bp; single-stranded, linear
  - 1..19: /note= "TCP1.30 primer"
gtgccagcaggtgaaccag

SEQ ID NO: 405 - DNA, 19 bp; single-stranded, linear
  - 1..19: /note= "TCP1.32B primer"
gcagtgcgtcttgaggagc

SEQ ID NO: 406 - DNA, 21 bp; single-stranded, linear
  - 1..21: /note= "TCP1.33 primer"
tggaaccatagcgtcagggag

SEQ ID NO: 407 - DNA, 21 bp; single-stranded, linear
  - 1..21: /note= "TCP1.34 primer"
ggcctccctgacgctatggtt

SEQ ID NO: 408 - DNA, 20 bp; single-stranded, linear
  - 1..20: /note= "TCP1.35 primer"
gckcggcgctgccactcagg

SEQ ID NO: 409 - DNA, 20 bp; single-stranded, linear
  - 1..20: /note= "TCP1.35t primer"
gctcggcgctgccactcagg

SEQ ID NO: 410 - DNA, 20 bp; single-stranded, linear
  - 1..20: /note= "TCP1.36 primer"
acgccgagaccaagcacttc

SEQ ID NO: 411 - DNA, 20 bp; single-stranded, linear
  - 1..20: /note= "TCP1.38 primer"
ccaaagaggtggcttcttcg

SEQ ID NO: 412 - DNA, 20 bp; single-stranded, linear
  - 1..20: /note= "TCP1.39 primer"
aaggccagcacgttcttcgc

SEQ ID NO: 413 - DNA, 19 bp; single-stranded, linear
  - 1..19: /note= "TCP1.40 primer"
cacgttcgtgcggcgcctg

SEQ ID NO: 414 - DNA, 19 bp; single-stranded, linear
  - 1..19: /note= "TCP1.41 primer"
ccttcaccaccagcgtgcg

SEQ ID NO: 415 - DNA, 19 bp; single-stranded, linear
  - 1..19: /note= "TCP1.42 primer"
ggcgacgacgtgctggttc

SEQ ID NO: 416 - DNA, 19 bp; single-stranded, linear
  - 1..19: /note= "TCP1.43 primer"
ggctcaggggcagcgccac

SEQ ID NO: 417 - DNA, 19 bp; single-stranded, linear
  - 1..19: /note= "TCP1.44 primer"
ctggcaggtgtacggcttc

SEQ ID NO: 418 - DNA, 25 bp; single-stranded, linear
  - 1..25: /note= "TCP1.45 primer"
gcgtggaccgagtgaccgtggtttc

SEQ ID NO: 419 - DNA, 21 bp; single-stranded, linear
  - 1..21: /note= "TCP1.46 primer"
gacgtggtggccgcgatgtgg

SEQ ID NO: 420 - DNA, 22 bp; single-stranded, linear
  - 1..22: /note= "TCP1.47 primer"
gaagtctgccgttgcccaagag

SEQ ID NO: 421 - DNA, 25 bp; single-stranded, linear
  - 1..25: /note= "TCP1.48 primer"
gacaccacacagaaaccacggtcac

SEQ ID NO: 422 - DNA, 21 bp; single-stranded, linear
  - 1..21: /note= "TCP1.49 primer"
cgccccctccttccgccaggt

SEQ ID NO: 423 - DNA, 25 bp; single-stranded, linear
  - 1..25: /note= "TCP1.50 primer"
cgaagccgaaggccagcacgttctt

SEQ ID NO: 424 - DNA, 22 bp; single-stranded, linear
  - 1..22: /note= "TCP1.51 primer"
ggtggcccgagtgctgcagagg

SEQ ID NO: 425 - DNA, 25 bp; single-stranded, linear
  - 1..25: /note= "TCP1.52 primer"
gtagctgcgcacgctggtggtgaag

SEQ ID NO: 426 - DNA, 22 bp; single-stranded, linear
  - 1..22: /note= "TCP1.53 primer"
tgggcgacgacgtgctggttca

SEQ ID NO: 427 - DNA, 25 bp; single-stranded, linear
  - 1..25: /note= "TCP1.54 primer"
tatggttccaggcccgttcgcatcc

SEQ ID NO: 428 - DNA, 23 bp; single-stranded, linear
  - 1..23: /note= "TCP1.55 primer"
ccagctgcgcctaccaggtgtgc

SEQ ID NO: 429 - DNA, 25 bp; single-stranded, linear
  - 1..25: /note= "TCP1.56 primer"
ggcctccctgacgctatggttccag

SEQ ID NO: 430 - DNA, 23 bp; single-stranded, linear
  - 1..23: /note= "TCP1.57 primer"
ggtgctgccgctggccacgttcg

SEQ ID NO: 431 - DNA, 25 bp; single-stranded, linear
  - 1..25: /note= "TCP1.58 primer"
tcccagggcacgcacaccaggcact

SEQ ID NO: 432 - DNA, 25 bp; single-stranded, linear
  - 1..25: /note= "TCP1.59 primer"
gtacagggcacacctttggtcactc

SEQ ID NO: 433 - DNA, 25 bp; single-stranded, linear
  - 1..25: /note= "TCP1.60 primer"
tcgacgacgtacacactcatcagcc

SEQ ID NO: 434 - DNA, 25 bp; single-stranded, linear
  - 1..25: /note= "TCP1.61 primer"
agcggcagcacctcgcggtagtggc

SEQ ID NO: 435 - DNA, 25 bp; single-stranded, linear
  - 1..25: /note= "TCP1.62 primer"
ccaccagctccttcaggcaggacac

SEQ ID NO: 436 - DNA, 25 bp; single-stranded, linear
  - 1..25: /note= "TCP1.63 primer"
ccagggcttcccacgtgcgcagcag

SEQ ID NO: 437 - DNA, 25 bp; single-stranded, linear
  - 1..25: /note= "TCP1.64 primer"
cgcacgaacgtggccagcggcagca

SEQ ID NO: 438 - DNA, 23 bp; single-stranded, linear
  - 1..23: /note= "TCP1.65 primer"
tgaccgtggtttctgtgtggtgt

SEQ ID NO: 439 - DNA, 25 bp; single-stranded, linear
  - 1..25: /note= "TCP1.66 primer"
ccctcttcaagtgctgtctgattcc

SEQ ID NO: 440 - DNA, 20 bp; single-stranded, linear
  - 1..20: /note= "TCP1.67 primer"
atcgcggccaccacgtccct

SEQ ID NO: 441 - DNA, 25 bp; single-stranded, linear
  - 1..25: /note= "TCP1.68 primer"
tgctccagacactcggccggtagaa

SEQ ID NO: 442 - DNA, 19 bp; single-stranded, linear
  - 1..19: /note= "TCP1.69 primer"
acgaagccgtacacctgcc

SEQ ID NO: 443 - DNA, 25 bp; single-stranded, linear
  - 1..25: /note= "TCP1.72 primer"
cgacatccctgcgttcttggctttc

SEQ ID NO: 444 - DNA, 21 bp; single-stranded, linear
  - 1..21: /note= "TCP1.73 primer"
cactgctggcctcattcaggg

SEQ ID NO: 445 - DNA, 18 bp; single-stranded, linear
  - 1..18: /note= "TCP1.74 primer"
gcgacatggagaacaagc

SEQ ID NO: 446 - DNA, 20 bp; single-stranded, linear
  - 1..20: /note= "TCP1.75 primer"
gcagccatactcagggacac

SEQ ID NO: 447 - DNA, 20 bp; single-stranded, linear
  - 1..20: /note= "TCP1.76 primer"
ccatcctctccacgctgctc

SEQ ID NO: 448 - DNA, 21 bp; single-stranded, linear
  - 1..21: /note= "TCP1.77 primer"
gcgatgacctccgtgagcctg

SEQ ID NO: 449 - DNA, 19 bp; single-stranded, linear
  - 1..19: /note= "TCP1.78 primer"
cccaggacaggctcacgga

SEQ ID NO: 450 - DNA, 24 bp; single-stranded, linear
  - 1..24: /note= "billTCP1 primer"
cctcttcaagtgctgtctgattcc

SEQ ID NO: 451 - DNA, 25 bp; single-stranded, linear
  - 1..25: /note= "billTCP2 primer"
cagctcgacgacgtacacactcatc

SEQ ID NO: 452 - DNA, 23 bp; single-stranded, linear
  - 1..23: /note= "billTCP4 primer"
ctgacgtccagactccgcttcat

SEQ ID NO: 453 - DNA, 33 bp; single-stranded, linear
  - 1..33: /note= "rpprim01 primer"
gacctgagcagctcgacgacgtacacactcatc

SEQ ID NO: 454 - DNA, 20 bp; single-stranded, linear
  - 1..20: /note= "Lt1 primer"
gtcgtcgagctgctcaggtc

SEQ ID NO: 455 - DNA, 20 bp; single-stranded, linear
  - 1..20: /note= "Lt2 primer"
agcacgctgaacagtgcctt

SEQ ID NO: 456 - DNA, 20 bp; single-stranded, linear
  - 1..20: /note= "Lt3 primer"
gacctgagcagctcgacgac

SEQ ID NO: 457 - DNA, 20 bp; single-stranded, linear
  - 1..20: /note= "Lt4 primer"
aaggcactgttcagcgtgct

SEQ ID NO: 458 - DNA, 20 bp; single-stranded, linear
  - 1..20: /note= "Lt5 primer"
cggccgagtgtctggagcaa

SEQ ID NO: 459 - DNA, 19 bp; single-stranded, linear
  - 1..19: /note= "Lt6 primer"
ggatgaagcggagtctgga

SEQ ID NO: 460 - DNA, 29 bp; single-stranded, linear
  - 1..29: /note= "BamH1Lt7 primer"
atggatccgtcgtcgagctgctcaggtct

SEQ ID NO: 461 - DNA, 29 bp; single-stranded, linear
  - 1..29: /note= "Sal1Lt8 primer"
atcagctgagcacgctgaacagtgccttc

SEQ ID NO: 462 - DNA, 24 bp; single-stranded, linear
  - 1..24: /note= "K303 primer"
gtctccgtgacataaaagaaagac

SEQ ID NO: 463 - DNA, 20 bp; single-stranded, linear
  - 1..20: /note= "K304 primer"
gccaagttcctgcactggct

SEQ ID NO: 464 - DNA, 24 bp; single-stranded, linear
  - 1..24: /note= "K305 primer"
gcctgttcttttgaaacgtggtct

SEQ ID NO: 465 - DNA, 24 bp; single-stranded, linear
  - 1..24: /note= "K306 primer"
  modified_base 1: /mod_base= OTHER /note= "N = guanosine substituted by two biotin groups"
ncctgttcttttgaaacgtggtct

SEQ ID NO: 466 - DNA, 22 bp; single-stranded, linear
  - 1..22: /note= "K311 primer"
gtcaagatgcctgagatagaac

SEQ ID NO: 467 - DNA, 22 bp; single-stranded, linear
  - 1..22: /note= "K312 and K313 primers"
tgcttagcttgtgggggtgtca

SEQ ID NO: 468 - DNA, 21 bp; single-stranded, linear
  - 1..21: /note= "K320 primer"
gctgcgtcctgctgcgcacgt

SEQ ID NO: 469 - DNA, 21 bp; single-stranded, linear
  - 1..21: /note= "K321 primer"
cagcggggagcgcgcggcatc

SEQ ID NO: 470 - DNA, 21 bp; single-stranded, linear
  - 1..21: /note= "K322 primer"
tgggccaccagcgcgcggaaa

SEQ ID NO: 471 - DNA, 25 bp; single-stranded, linear
  - 1..25: /note= "slanti.1 primer"
cggccgcagcccgtcaggcttgggg

SEQ ID NO: 472 - DNA, 24 bp; single-stranded, linear
  - 1..24: /note= "slanti.2 primer"
ccgacagctcccgcagctgcaccc

SEQ ID NO: 473 - DNA, 34 bp; single-stranded, linear
  - 1..34: /note= "slanti.3 primer"
cgtacacactcatcagccagtgcaggaacttggc

SEQ ID NO: 474 - DNA, 46 bp; single-stranded, linear
  - 1..46: /note= "slanti.4 primer"
cgcgcccgctcgtagttgagcacgctgaacagtgccttcaccctcg

SEQ ID NO: 475 - DNA, 39 bp; single-stranded, linear
  - 1..39: /note= "slanti.5 primer"
gcggagtctggacgtcagcagggcgggcctggcttcccg

SEQ ID NO: 476 - DNA, 27 bp; single-stranded, linear
  - 1..27: /note= "UTR2 primer"
atttgacccacagggacccccatccag

SEQ ID NO: 477 - DNA, 20 bp; single-stranded, linear
  - 1..20: /note= "FW5 primer"
atgaccgccctcctcgtgag

SEQ ID NO: 478 - DNA, 17 bp; single-stranded, linear
  - 1..17: /note= "Nam1 primer"
gccacccccgcgatgcc

SEQ ID NO: 479 - DNA, 17 bp; single-stranded, linear
  - 1..17: /note= "Nam2 primer"
agccctggccccggcca

SEQ ID NO: 480 - DNA, 17 bp; single-stranded, linear
  - 1..17: /note= "Nam3 primer"
tcccacgtgcgcagcag

SEQ ID NO: 481 - DNA, 17 bp; single-stranded, linear
  - 1..17: /note= "Nam4 primer"
agcaggacgcagcgctg

SEQ ID NO: 482 - DNA, 34 bp; single-stranded, linear
  - 1..34: /note= "PE01 primer"
cgcggtagtggctgcgcagcagggagcgcacggc

SEQ ID NO: 483 - DNA, 35 bp; single-stranded, linear
  - 1..35: /note= "PE02 primer"
ccagggcttcccacgtgcgcagcaggacgcagcgc

SEQ ID NO: 484 - DNA, 62 bp; single-stranded, linear
  - 1..62: /note= "LM101 primer"
ctagtctagatcrctagcgtaatctggaacatcgtatgggtrtccaggatggtcttgaagtc

SEQ ID NO: 485 - DNA, 39 bp; single-stranded, linear
  - 1..39: /note= "LM103 primer"
taccatgggctacccatacgacgttccagattacgctca

SEQ ID NO: 486 - DNA, 39 bp; single-stranded, linear
  - 1..39: /note= "LM104 primer"
tatgagcgtaatctggaacgtcgtatgggtagcccatgg

SEQ ID NO: 487 - DNA, 45 bp; single-stranded, linear
  - 1..45: /note= "LM105 primer"
gtgtacgtcgtcgagctcctcaggtctgccttttatgtcacggag

SEQ ID NO: 488 - DNA, 48 bp; single-stranded, linear
  - 1..48: /note= "LM106 primer"
gtgtacgtcgtcgagctcctcaggtctttcgcttatgtcacggagacc

SEQ ID NO: 489 - DNA, 48 bp; single-stranded, linear
  - 1..48: /note= "LM107 primer"
cctcaggtctttctttgctgtcacggagacaacgtttcaaaagaacag

SEQ ID NO: 490 - DNA, 43 bp; single-stranded, linear
  - 1..43: /note= "LM108 primer"
ggtctttcttttatgtcgcggagacaacgtttcaaaagaacag

SEQ ID NO: 491 - DNA, 40 bp; single-stranded, linear
  - 1..40: /note= "LM109 primer"
ctttcttttatgtcacggcgacaacgtttcaaaagaacag

SEQ ID NO: 492 - DNA, 63 bp; single-stranded, linear
  - 1..63: /note= "LM_FFYTE primer"
atgagtgtgtacgtcgtcgagctcctcaggtctaccacgtttcaaaagaacaggctctttttc

SEQ ID NO: 493 - DNA, 25 bp; single-stranded, linear
  - 1..25: /note= "TCP061 primer"
ggctgatgagtgtgtacgtcgtcga

SEQ ID NO: 494 - DNA, 25 bp; single-stranded, linear
  - 1..25: /note= "HUMO1 primer"
acgtggtctccgtgacataaaagaa

SEQ ID NO: 495 - DNA, 23 bp; single-stranded, linear
  - 1..23: /note= "HUMO2 primer"
aggtctttcttttatgtcacgga

SEQ ID NO: 496 - DNA, 22 bp; single-stranded, linear
  - 1..22: /note= "HUMO3 primer"
cacagacccccgtcgcctggtc

SEQ ID NO: 497 - DNA, 23 bp; single-stranded, linear
  - 1..23: /note= "HUMO4 primer"
cggagtctggacgtcagcagggc

SEQ ID NO: 498 - DNA, 39 bp; single-stranded, linear
  - 1..39: /note= "SLW F1N primer"
cgcggatccgtaactaaaatgccgcgcgctccccgctgc

SEQ ID NO: 499 - DNA, 42 bp; single-stranded, linear
  - 1..42: /note= "SLW F1C primer"
ccggaattcgttagttacttacaaagaggtggcttcttcggc

SEQ ID NO: 500 - DNA, 39 bp; single-stranded, linear
  - 1..39: /note= "SLW F2N primer"
cgcggatccgtaactaaagccacctctttggagggtgcg

SEQ ID NO: 501 - DNA, 42 bp; single-stranded, linear
  - 1..42: /note= "SLW F2C primer"
ccggaattcgttagttacttaagacctgagcagctcgacgac

SEQ ID NO: 502 - DNA, 39 bp; single-stranded, linear
  - 1..39: /note= "SLW F3N primer"
cgcggatccgtaactaaaatgagtgtgtacgtcgtcgag

SEQ ID NO: 503 - DNA, 40 bp; single-stranded, linear
  - 1..42: /note= "SLW F3C primer"
ccggaattcgttagttacttagatcccctggcactggacg

SEQ ID NO: 504 - DNA, 39 bp; single-stranded, linear
  - 1..39: /note= "SLW F4N primer"
cgcggatccgtaactaaaatcccgcagggctccatcctc

SEQ ID NO: 505 - DNA, 42 bp; single-stranded, linear
  - 1..42: /note= "SLW F4C primer"
ccggaattcgttagttacttagtccaggatggtcttgaagtc

SEQ ID NO: 506 - DNA (other nucleic acid), 21 bp; single-stranded, linear
  - 1..21: /note= "40-60 primer"
  description: /desc = "phosphorothioate"
ggcatcgcgggggtggccggg

SEQ ID NO: 507 - DNA (other nucleic acid), 21 bp; single-stranded, linear
  - 1..21: /note= "260-280 primer"
  description: /desc = "phosphorothioate"
ggacacctggcggaaggaggg

SEQ ID NO: 508 - DNA (other nucleic acid), 21 bp; single-stranded, linear
  - 1..21: /note= "500-520 primer"
  description: /desc = "phosphorothioate"
gcgtgccagcaggtgaaccag

SEQ ID NO: 509 - DNA (other nucleic acid), 21 bp; single-stranded, linear
  - 1..21: /note= "770-790 primer"
  description: /desc = "phosphorothioate"
ctcaggggcagcgccacgcct

SEQ ID NO: 510 - DNA (other nucleic acid), 21 bp; single-stranded, linear
  - 1..21: /note= "885-905 primer"
  description: /desc = "phosphorothioate"
aggtggcttcttcggcgggtc

SEQ ID NO: 511 - DNA (other nucleic acid), 21 bp; single-stranded, linear
  - 1..21: /note= "1000-1020 primer"
  description: /desc = "phosphorothioate"
ggacaaggcgtgtcccaggga

SEQ ID NO: 512 - DNA (other nucleic acid), 21 bp; single-stranded, linear
  - 1..21: /note= "1300-1320 primer"
  description: /desc = "phosphorothioate"
gctggggtgaccgcagctcgc

SEQ ID NO: 513 - DNA (other nucleic acid), 21 bp; single-stranded, linear
  - 1..21: /note= "1520-1540 primer"
  description: /desc = "phosphorothioate"
gatgaacttcttggtgttcct

SEQ ID NO: 514 - DNA (other nucleic acid), 21 bp; single-stranded, linear
  - 1..21: /note= "2110-2130 primer"
  description: /desc = "phosphorothioate"
gtgcgccaggccctgtggata

SEQ ID NO: 515 - DNA (other nucleic acid), 21 bp; single-stranded, linear
  - 1..21: /note= "2295-2315 primer"
  description: /desc = "phosphorothioate"
gcccatgggcggccttctgga

SEQ ID NO: 516 - DNA (other nucleic acid), 21 bp; single-stranded, linear
  - 1..21: /note= "2450-2470 primer"
  description: /desc = "phosphorothioate"
gaggccactgctggcctcatt

SEQ ID NO: 517 - DNA (other nucleic acid), 21 bp; single-stranded, linear
  - 1..21: /note= "2670-2690 primer"
  description: /desc = "phosphorothioate"
gggtgaggtgaggtgtcacca

SEQ ID NO: 518 - DNA (other nucleic acid), 31 bp; single-stranded, linear
  - 1..31: /note= "3080-3110 primer"
  description: /desc = "phosphorothioate"
gctgcagcacacatgcgtgaaacctgtacgc

SEQ ID NO: 519 - DNA (other nucleic acid), 21 bp; single-stranded, linear
  - 1..21: /note= "3140-3160 primer"
  description: /desc = "phosphorothioate"
gacgcgcaggaaaaatgtggg

SEQ ID NO: 520 - DNA (other nucleic acid), 21 bp; single-stranded, linear
  - 1..21: /note= "3690-3710 primer"
  description: /desc = "phosphorothioate"
ccgagcgccagcctgtgggga

SEQ ID NO: 521 - DNA (other nucleic acid), 21 bp; single-stranded, linear
  - 1..21: /note= "55-75 primer"
  description: /desc = "phosphorothioate"
cagcggggagcgcgcggcatc

SEQ ID NO: 522 - DNA (other nucleic acid), 21 bp; single-stranded, linear
  - 1..21: /note= "151-171 primer"
  description: /desc = "phosphorothioate"
cagcacctcgcggtagtggct

SEQ ID NO: 523 - DNA, 22 bp; single-stranded, linear
  - 1..22: /note= "TP1.1 primer"
tcaagccaaacctgaatctgag

SEQ ID NO: 524 - DNA, 21 bp; single-stranded, linear
  - 1..21: /note= "TP1.2 primer"
cccgagtgaatctttctacgc

SEQ ID NO: 525 - DNA, 23 bp; single-stranded, linear
  - 1..23: /note= "TP1.3 primer"
gtctctggcagtttcctcatccc

SEQ ID NO: 526 - DNA, 22 bp; single-stranded, linear
  - 1..22: /note= "TP1.4 primer"
tttaggcatcctcccaagcaca

SEQ ID NO: 527 - DNA, 10 bp; single-stranded, linear
ttagggttag

SEQ ID NO: 528 - DNA, 18 bp; single-stranded, linear
ttagggttagggttaggg

SEQ ID NO: 529 - DNA, 18 bp; single-stranded, linear
gttagggttagggttagg

SEQ ID NO: 530 - DNA, 60 bp; single-stranded, linear
  repeat_unit 1..6: /note= "sequence (CCCTAA)-n, where n is at least 1, or at least 3, or at least 10 or more"
ccctaaccctaaccctaaccctaaccctaaccctaaccctaaccctaaccctaaccctaa

SEQ ID NO: 531 - DNA, 34 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnttag

SEQ ID NO: 532 - DNA, 34 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnaggg

SEQ ID NO: 533 - DNA, 40 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnttagggttag

SEQ ID NO: 534 - DNA, 46 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnttagggttagggttag

SEQ ID NO: 535 - DNA, 52 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnttagggttagggttagggttag

SEQ ID NO: 536 - DNA, 58 bp; single-stranded, linear
  misc_feature 1..30: /note= "non-telomeric nucleotide sequence, (X)-n, where n is 8-20, or 6-30"
nnnnnnnnnnnnnnnnnnnnnnnnnnnnnnttagggttagggttagggttagggttag

SEQ ID NO: 537 - DNA, 10 bp; single-stranded, linear
  - 1..10: /note= "primer terminating at template boundary"
tagggattag

SEQ ID NO: 538 - DNA, 16 bp; single-stranded, linear
  - 1..16: /note= "primer for hTRT nucleolytic assay"
  modified_base 16: /mod_base= OTHER /note= "N = 3'-deoxyguanosine"
ttagggttagggttan

SEQ ID NO: 539 - DNA, 60 bp; single-stranded, linear
  repeat_unit 1..6: /note= "sequence (TTAGGG)-n, where n is 1-10, or typically 3-5"
ttagggttagggttagggttagggttagggttagggttagggttagggttagggttaggg

SEQ ID NO: 540 - protein, 5 aa
WXGXS

SEQ ID NO: 541 - protein, 4 aa
PRRR

SEQ ID NO: 542 - protein, 6 aa
PKRPRR

SEQ ID NO: 543 - DNA, 18 bp; single-stranded, linear
  - 1..18: /note= "antisense hTRT molecule"
gctctagaatgaagggtg

SEQ ID NO: 544 - DNA, 21 bp; single-stranded, linear
  - 1..21: /note= "S1 control oligonucleotide"
gcgacgactgacattggccgg

SEQ ID NO: 545 - DNA, 21 bp; single-stranded, linear
  - 1..21: /note= "S2 control oligonucleotide"
ggctcgaagtagcaccggtgc

SEQ ID NO: 546 - DNA, 21 bp; single-stranded, linear
  - 1..21: /note= "S3 control oligonucleotide"
gtgggaacaggccgatgtccc

SEQ ID NO: 547 - DNA, 30 bp; single-stranded, linear
  - 1..30: /note= "ON1 oligonucleotide"
tcccacgtgcgcagcaggacgcagcgctgc

SEQ ID NO: 548 - DNA, 30 bp; single-stranded, linear
  - 1..30: /note= "ON2 oligonucleotide"
gccggggccagggcttcccacgtgcgcagc

SEQ ID NO: 549 - DNA, 30 bp; single-stranded, linear
  - 1..30: /note= "ON3 oligonucleotide"
ggcatcgcgggggtggccggggccagggct

SEQ ID NO: 550 - DNA, 20 bp; single-stranded, linear
  - 1..20: /note= "delta-182 species specific primer"
ggcactggacgtaggacgtg

SEQ ID NO: 551 - DNA, 20 bp; single-stranded, linear
  - 1..20: /note= "293 cell line lambda cDNA library PCR primer"
cggaagagtgtctggagcaa

SEQ ID NO: 552 - DNA, 23 bp; single-stranded, linear
  - 1..23: /note= "GAPDH control primer K136"
ctcagacaccatggggaaggtga

SEQ ID NO: 553 - DNA, 23 bp; single-stranded, linear
  - 1..23: /note= "GAPDH control primer K137"
atgatcttgaggctgttgtcata

SEQ ID NO: 554 - DNA, 31 bp; single-stranded, linear
  - 1..31: /note= "competitor oligonucleotide"
tagacctgttagtgtacatttgaattgaagc

SEQ ID NO: 555 - DNA, 30 bp; single-stranded, linear
  - 1..30: /note= "competitor oligonucleotide"
tagacctgttaggttggatttgtggcatca

SEQ ID NO: 556 - DNA, 26 bp; single-stranded, linear
  - 1..26: /note= "biotin-labeled telomerase-specific oligonucleotide"
  modified_base 1: /mod_base= OTHER /note= "N = thymidine modified by a biotin group"
  modified_base 12..13: /mod_base= gm
  modified_base 14..17: /mod_base= um
  modified_base 18..21: /mod_base= gm
  modified_base 22..25: /mod_base= um
  modified_base 26: /mod_base= gm
nagacctgttannnnnnnnnnnnnnn

SEQ ID NO: 557 - DNA, 26 bp; single-stranded, linear
  - 1..31: /note= "displacement deoxyoligonucleotide"
caaaaccccaaaacctaacaggtcta

SEQ ID NO: 558 - DNA, 103 bp; single-stranded, linear
  - 1..103: /note= "5' primer encoding a hammerhead ribozyme, a T7-promoter and an EcoR1 site"
gcgggaattctaatacgactcactatagggaagaaactctgatgaggccgaaaggccgaaactccacgaaagtggagtaagtttctcgataattgatctgtag

SEQ ID NO: 559 - DNA, 36 bp; single-stranded, linear
  - 1..36: /note= "3' primer including an EarI site and a BamH1 site"
cggggatcctcttcaaaagatgagaggacagcaaac

SEQ ID NO: 560 - DNA, 60 bp; single-stranded, linear
  - 1..60: /note= "hairpin primer"
ccccaaaaccccaaaaccccaaaacccccacaggggttttggggttttggggttttgggg

SEQ ID NO: 561 - DNA, 58 bp; single-stranded, linear
  - 1..58: /note= "hairpin primer"
ccaaaaccccaaaaccccaaaacccccacaggggttttggggttttggggttttgggg

SEQ ID NO: 562 - DNA, 56 bp; single-stranded, linear
  - 1..56: /note= "hairpin primer"
aaaaccccaaaaccccaaaacccccacaggggttttggggttttggggttttgggg

SEQ ID NO: 563 - DNA, 54 bp; single-stranded, linear
  - 1..54: /note= "hairpin primer"
aaccccaaaaccccaaaacccccacaggggttttggggttttggggttttgggg

SEQ ID NO: 564 - DNA, 48 bp; single-stranded, linear
  - 1..48: /note= "hairpin primer"
ccccaaaaccccaaaacccccacaggggttttggggttttggggtttt

SEQ ID NO: 565 - DNA, 52 bp; single-stranded, linear
  - 1..52: /note= "hairpin primer"
aaaaccccaaaaccccaaaacccccacaggggttttggggttttggggtttt

SEQ ID NO: 566 - DNA, 50 bp; single-stranded, linear
  - 1..50: /note= "hairpin primer"
aaccccaaaaccccaaaacccccacaggggttttggggttttggggtttt

SEQ ID NO: 567 - DNA, 46 bp; single-stranded, linear
  - 1..46: /note= "hairpin primer"
ccaaaaccccaaaacccccacaggggttttggggttttggggtttt

SEQ ID NO: 568 - DNA, 44 bp; single-stranded, linear
  - 1..44: /note= "hairpin primer"
aaaaccccaaaacccccacaggggttttggggttttggggtttt

SEQ ID NO: 569 - DNA, 27 bp; single-stranded, linear
  - 1..27: /note= "degenerate oligonucleotide primer for cloning of Euplotes telomerase 123 kDa protein subunit"
tctraartartgdgtnadrttrttcat

SEQ ID NO: 570 - DNA, 31 bp; single-stranded, linear
  - 1..31: /note= "degenerate oligonucleotide primer for cloning of Euplotes telomerase 123 kDa protein subunit"
gcggatccatgaayccwgaraayccwaaygt

SEQ ID NO: 571 - DNA, 20 bp; single-stranded, linear
  - 1..20: /note= "degenerate oligonucleotide primer for cloning of Euplotes telomerase 43 kDa protein subunit"
nnngtnachgghathaayaa

SEQ ID NO: 572 - DNA, 21 bp; single-stranded, linear
  - 1..21: /note= "degenerate oligonucleotide primer for cloning of Euplotes telomerase 43 kDa protein subunit"
dgcdgtytcytgrtcrttrta

SEQ ID NO: 573 - DNA, 23 bp; single-stranded, linear
  - 1..23: /note= "degenerate oligonucleotide primer for cloning of Oxytricha trifallax telomerase homologous to Euplotes 123 kDa protein subunit"
yarachaargghatycchyargg

SEQ ID NO: 574 - DNA, 21 bp; single-stranded, linear
  - 1..23: /note= "degenerate oligonucleotide primer for cloning of Oxytricha trifallax telomerase homologous to Euplotes 123 kDa protein subunit"
dgtdatnarnarrtartcrtc

SEQ ID NO: 575 - DNA, 23 bp; single-stranded, linear
  - 1..23: /note= "K231 forward primer"
  modified_base 1: /mod_base= OTHER /note= "N = guanosine modified by a biotin group"
ncctatttyttytaynnnacnga

SEQ ID NO: 576 - DNA, 23 bp; single-stranded, linear
  - 1..23: /note= "K220 reverse primer"
ccagatatnadnarraartcrtc

SEQ ID NO: 577 - protein, 6 aa
  Modified-site 5: /product= "OTHER" /note= "Xaa = Phe, Ile or Leu"
DDFLXI

SEQ ID NO: 578 - DNA, 23 bp; single-stranded, linear
  - 1..23: /note= "K228 forward primer"
acaatgmgnhtnhtnccnaaraa

SEQ ID NO: 579 - protein, 6 aa
  Modified-site 2..3: /product= "OTHER" /note= "Xaa = Leu or Ile"
RXXPKK

SEQ ID NO: 580 - DNA, 26 bp; single-stranded, linear
  - 1..26: /note= "K224 reverse primer"
acgaatcknggdatnswrtcrtarca

SEQ ID NO: 581 - protein, 7 aa
CYDSIPR

SEQ ID NO: 582 - DNA, 26 bp; single-stranded, linear
  - 1..26: /note= "K227 reverse primer"
caattctcrtarcanswyttdatrtc

SEQ ID NO: 583 - protein, 7 aa
DIKSCYD

SEQ ID NO: 584 - DNA (genomic), 269 bp; single-stranded, linear
  - 1..269: /note= "clone 168-3"
gattactcccgaagaaaggatctttccgtccaatcatgactttcttaagaaaggacaagcaaaaaaatattaagttaaatctaaattaaattctaatggatagccaacttgtgtttaggaatttaaaagacatgctgggataaaagataggatactcagtctttgataataaacaaatttcagaaaaatttgcctaattcatagagaaatggaaaaataaaggaagacctcagctatattatgtcactctagacataaagacttgctac

SEQ ID NO: 585 - DNA, 20 bp; single-stranded, linear
  - 1..23: /note= "K297 primer"
gagtgacataatatacgtga

SEQ ID NO: 586 - DNA (genomic), 474 bp; single-stranded, linear
  - 1..474: /note= "Tetrahymena DNA fragment"
aaacacaaggaaggaagtcaaatattctattaccgtaaaccaatatggaaattagtgagtaaattaactattgtcaaagtaagaatttagttttctgaaaagaataaataaatgaaaaataatttttatcaaaaaatttagcttgaagaggagaatttggaaaaagttgaagaaaaattgataccagaagattcattttagaaataccctcaaggaaagctaaggattatacctaaaaaaggatctttccgtccaatcatgactttcttaagaaaggacaagcaaaaaaatattaagttaaatctaaattaaattctaatggatagccaacttgtgtttaggaatttaaaagacatgctgggataaaagataggatactcagtctttgataataaacaaatttcagaaaaatttgcctaattcatagagaaatggaaaaataaaggaagacctcagctatattatgtcactcta

SEQ ID NO: 587 - DNA, 50 bp; single-stranded, linear
  - 1..50: /note= "Q-T primer"
ccagtgagcagagtgacgaggactcgagctcaagcttttttttttttttt

SEQ ID NO: 588 - DNA, 18 bp; single-stranded, linear
  - 1..18: /note= "Q-O primer"
ccagtgagcagagtgacg

SEQ ID NO: 589 - DNA, 32 bp; single-stranded, linear
  - 1..32: /note= "M2-T primer"
gtgtcatttctatatggaagatttgattgatg

SEQ ID NO: 590 - DNA, 18 bp; single-stranded, linear
  - 1..18: /note= "Q-I primer"
gaggactcgagctcaagc

SEQ ID NO: 591 - DNA, 32 bp; single-stranded, linear
  - 1..32: /note= "M2-T2 primer"
acctatcgtttacgaaaaagaaaggatcagtg

SEQ ID NO: 592 - DNA, 32 bp; single-stranded, linear
  - 1..32: /note= "M2-B primer"
cactgatcctttctttttcgtaaacgataggt

SEQ ID NO: 593 - DNA, 31 bp; single-stranded, linear
  - 1..31: /note= "M2-B2 primer"
catcaatcaaatcttccatatagaaatgaca

SEQ ID NO: 594 - DNA, 27 bp; single-stranded, linear
  - 1..27: /note= "PCR Adapt SfiI primer"
  modified_base 1: /mod_base= OTHER /note= "N = 5'-phosphorylated guanosine"
nggccgtgttggcctagttctctgctc

SEQ ID NO: 595 - DNA, 38 bp; single-stranded, linear
  - 1..38: /note= "PCR Adapt SfiII primer"
gaggaggagaagagcagagaactaggccaacacgcccc

SEQ ID NO: 596 - DNA, 19 bp; single-stranded, linear
  - 1..19: /note= "TCP1.3 primer"
atgctcctgcgtttggtgg

SEQ ID NO: 597 - DNA, 26 bp; single-stranded, linear
  - 1..26: /note= "F3b primer"
tctaaccctaactgagaagggcgtag

SEQ ID NO: 598 - DNA, 26 bp; single-stranded, linear
  - 1..26: /note= "R3c primer"
gtttgctctagaatgaacggtggaag

SEQ ID NO: 599 - DNA (genomic), 170 bp; single-stranded, linear
  - 1..170: /note= "104-base intronic sequence (SEQ ID NO:7) inserted at the junction corresponding to bases 274 and 275 of hTRT (SEQ ID NO:1)"
  intron 28..131: /note= "intronic sequence"
ccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcag

SEQ ID NO: 600 - protein, 1285 aa
  Protein 1..1285: /note= "fusion protein composed of enterokinase cleavable, His tagged thioredoxin moiety and full length hTRT"
MSDKIIHLTDDSFDTDVLKADGAILVDFWAHWCGPCKMIAPILDEIADEYQGKLTVAKLRIDHNPGTAPKYGIRGIPTLLLFKNGEVAATKVGALSKGQLKEFLDANLAGSGSGDDDDKVPMHELEIFEFAAASTQRCVLLRTWEALAPATPAMPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 601 - protein, 5 aa
GSVTK

SEQ ID NO: 602 - protein, 538 aa [sequence omitted]

SEQ ID NO: 603 - protein, 530 aa [sequence omitted]

SEQ ID NO: 604 - protein, 515 aa
  Protein 1..515: /note= "fusion protein composed of glutathione-S-transferase sequence, thrombin cleavage sequence, recognition sequence for heart muscle protein kinase, residues introduced by cloning and hTRT protein fragment"
MSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKSDLVPRGSRRASVGSVTKMSVYVVELLRSFFYVTETTFQKNRLFFYRPSVWSKLQSIGIRQHLKRVQLRELSEAEVRQHREARPALLTSRLRFIPKPDGLRPIVNMDYVVGARTFRREKRAERLTSRKALFSVLNYERARRPGLLGASVLGLDDIHRAWRTFVLRVRAQDPPPEYFVKVDVTGAYDTIPQDRLTEVIASIIKPQNTYCVRRYAVVQKAAHGVRKAFKSHVSTLTDLQPYMRQFVAHLQETSPLRDAVVIEQSSSLNEASGLFDVFLRFMCHHAVRIRGKSYVQCQGI

SEQ ID NO: 605 - protein, 514 aa [sequence omitted]

SEQ ID NO: 606 - protein, 517 aa [sequence omitted]

SEQ ID NO: 607 - DNA, 30 bp; single-stranded, linear
  - 1..30: /note= "oligonucleotide used to modify hTRT cDNA nucleotides 779 to 781 from GCG to CAT"
ccggccaccccccatatgccgcgcgctccc

SEQ ID NO: 608 - DNA, 58 bp; single-stranded, linear
  - 1..58: /note= "oligonucleotide used to create expression vectors pGRN127, pGRN128 and pGRN130"
tgcgcacgtgggaagccctggcagatctgaattccaccatgccgcgcgctccccgctg

SEQ ID NO: 609 - DNA, 60 bp; single-stranded, linear
  - 1..60: /note= "oligonucleotide used to create expression vectors pGRN129 and pGRN130"
cgggacgggctgctcctgcgtttggtggacgcgttcttgttggtgacacctcacctcacc

SEQ ID NO: 610 - protein, 5 aa
NSAVD

SEQ ID NO: 611 - protein, 1154 aa
  Protein 1..1154: /note= "fusion protein composed of hTRT protein sequence, vector sequences, the Myc epitope and His6 tag"
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILDLEQKLISEEDLNSAVDHHHHHH

SEQ ID NO: 612 - protein, 1200 aa
  Protein 1..1200: /note= "fusion protein composed of His6 and Anti-Xpress tags, enterokinase cleavage site and full length hTRT protein"
MPRGSHHHHHHGMASMTGGQQMGRDLYDDDDLDPSSRSAAGTMEFAAASTQRCVLLRTWEALAPATPAMPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 613 - protein, 1189 aa
  Protein 1..1189: /note= "fusion protein composed of melittin signal sequence and full length hTRT protein"
MKFLVNVALVFMVVYISYIYADPSSRSAAGTMEFAAASTQRCVLLRTWEALAPATPAMPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 614 - DNA, 92 bp; single-stranded, linear
  - 1..92: /note= "oligonucleotide used to create expression vectors pGRN128 and pGRN129"
ctgccctcagacttcaagaccatcctggactacaaggacgacgatgacaaatgaattcagatctgcggccgccaccgcggtggagctccagc

SEQ ID NO: 615 - DNA, 53 bp; single-stranded, linear
  - 1..53: /note= "mutagenic oligo used to add a CSP45I site at the C-terminus of hTRT"
cttcaagaccatcctggactttcgaaacgcggccgccaccgcggtggagctcc

SEQ ID NO: 616 - DNA, 33 bp; single-stranded, linear
  - 1..33: /note= "oligonucleotide RA45"
gccacccccgcgctgcctcgagctccccgctgc

SEQ ID NO: 617 - DNA, 48 bp; single-stranded, linear
  - 1..48: /note= "primer hTR+1"
ggggaagctttaatacgactcactatagggttgcggagggtgggcctg

SEQ ID NO: 618 - DNA, 36 bp; single-stranded, linear
  - 1..36: /note= "primer hTR+445"
ccccggatcctgcgcatgtgtgagccgagtcctggg

SEQ ID NO: 619 - DNA, 62 bp; single-stranded, linear
  - 1..62: /note= "synthetic telomerase product"
attccgtcgagcagagttagggttagggttagggttagggttagggttagggttagggttag

SEQ ID NO: 620 - DNA, 18 bp; single-stranded, linear
  - 1..18: /note= "primer M2"
aatccgtcgagcagagtt

SEQ ID NO: 621 - DNA, 18 bp; single-stranded, linear
  - 1..18: /note= "primer H3.03"
ttagggttagggttaggg

SEQ ID NO: 622 - DNA, 18 bp; single-stranded, linear
aatccgtcgagcagaggg

SEQ ID NO: 623 - DNA, 18 bp; single-stranded, linear
aatccgtcgagcagatag

SEQ ID NO: 624 - DNA, 84 bp; single-stranded, linear
  - 1..84: /note= "T701 primer"
gggagatcttaatacgactcactatagattcaggccatggtgctgcgccggctgtcaggctcccacgacgtagtccatgttcac

SEQ ID NO: 625 - DNA, 32 bp; single-stranded, linear
  - 1..32: /note= "reverse01 primer"
gggtctagatccggaagagtgtctggagcaag

SEQ ID NO: 626 - DNA, 84 bp; single-stranded, linear
  - 1..84: /note= "T702 primer"
gggagatcttaatacgactcactatagattcaggccatggtgctgcgccggctgtcagggcggccttctggaccacggcatacc

SEQ ID NO: 627 - DNA, 30 bp; single-stranded, linear
  - 1..30: /note= "reverse02 primer"
ggtctagacgatatccacagggcctggcgc

SEQ ID NO: 628 - protein, 1407 aa [sequence omitted]

SEQ ID NO: 629 - DNA, 18 bp; single-stranded, linear
  - 1..18: /note= "TS primer"
aatccgtcgagcagagtt

SEQ ID NO: 630 - DNA, 30 bp; single-stranded, linear
  - 1..30: /note= "ACX primer"
gcgcggcttacccttacccttaccctaacc

SEQ ID NO: 631 - DNA, 18 bp; single-stranded, linear
  - 1..18: /note= "U2 primer"
atcgcttctcggcctttt

SEQ ID NO: 632 - DNA, 36 bp; single-stranded, linear
  - 1..36: /note= "TSU2 primer"
aatccgtcgagcagagttaaaaggccgagaagcgat

SEQ ID NO: 633 - protein, 6 aa
  Modified-site 1: /product= "OTHER" /note= "Xaa = hydrophobic amino acid, Ala, Leu, Ile, Val, Pro, Phe, Trp or Met"
  Modified-site 3: /product= "OTHER" /note= "Xaa = hydrophobic amino acid, Ala, Leu, Ile, Val, Pro, Phe, Trp or Met"
XRXXPK

SEQ ID NO: 634 - protein, 7 aa
  Modified-site 1: /product= "OTHER" /note= "Xaa = Phe or Leu"
  Modified-site 3: /product= "OTHER" /note= "Xaa = hydrophobic amino acid, Ala, Leu, Ile, Val, Pro, Phe, Trp or Met"
  Modified-site 7: /product= "OTHER" /note= "Xaa = hydrophobic amino acid, Ala, Leu, Ile, Val, Pro, Phe, Trp or Met"
XRXIXXX

SEQ ID NO: 635 - protein, 17 aa
  Modified-site 6: /product= "OTHER" /note= "Xaa = hydrophobic amino acid, Ala, Leu, Ile, Val, Pro, Phe, Trp or Met"
  Modified-site 8: /product= "OTHER" /note= "Xaa = hydrophobic amino acid, Ala, Leu, Ile, Val, Pro, Phe, Trp or Met"
  Modified-site 10: /product= "OTHER" /note= "Xaa = hydrophobic amino acid, Ala, Leu, Ile, Val, Pro, Phe, Trp or Met"
PXLYFXXXDXXXCYDXI

SEQ ID NO: 636 - protein, 19 aa
  Modified-site 18: /product= "OTHER" /note= "Xaa = hydrophobic amino acid, Ala, Leu, Ile, Val, Pro, Phe, Trp or Met"
KXYXQXXGIPQGSXLSXXL

SEQ ID NO: 637 - protein, 12 aa
  Modified-site 10: /product= "OTHER" /note= "Xaa = hydrophobic amino acid, Ala, Leu, Ile, Val, Pro, Phe, Trp or Met"
LLRLXDDXLXIT

SEQ ID NO: 638 - DNA, 3396 bp; single-stranded, linear
  - 1..3396: /note= "hTRT-encoding sequence employing alternative codon distributions for E. coli (all genes)"
atgccgcgcgcgccgcgctgccgcgcggtgcgcagcctgctgcgcagccattatcgcgaagtgctgccgctggcgacctttgtgcgccgcctgggcccgcagggctggcgcctggtgcagcgcggcgatccggcggcgtttcgcgcgctggtggcgcagtgcctggtgtgcgtgccgtgggatgcgcgcccgccgccggcggcgccgagctttcgccaggtgagctgcctgaaagaactggtggcgcgcgtgctgcagcgcctgtgcgaacgcggcgcgaaaaacgtgctggcgtttggctttgcgctgctggatggcgcgcgcggcggcccgccggaagcgtttaccaccagcgtgcgcagctatctgccgaacaccgtgaccgatgcgctgcgcggcagcggcgcgtggggcctgctgctgcgccgcgtgggcgatgatgtgctggtgcatctgctggcgcgctgcgcgctgtttgtgctggtggcgccgagctgcgcgtatcaggtgtgcggcccgccgctgtatcagctgggcgcggcgacccaggcgcgcccgccgccgcatgcgagcggcccgcgccgccgcctgggctgcgaacgcgcgtggaaccatagcgtgcgcgaagcgggcgtgccgctgggcctgccggcgccgggcgcgcgccgccgcggcggcagcgcgagccgcagcctgccgctgccgaaacgcccgcgccgcggcgcggcgccggaaccggaacgcaccccggtgggccagggcagctgggcgcatccgggccgcacccgcggcccgagcgatcgcggcttttgcgtggtgagcccggcgcgcccggcggaagaagcgaccagcctggaaggcgcgctgagcggcacccgccatagccatccgagcgtgggccgccagcatcatgcgggcccgccgagcaccagccgcccgccgcgcccgtgggataccccgtgcccgccggtgtatgcggaaaccaaacattttctgtatagcagcggcgataaagaacagctgcgcccgagctttctgctgagcagcctgcgcccgagcctgaccggcgcgcgccgcctggtggaaaccatttttctgggcagccgcccgtggatgccgggcaccccgcgccgcctgccgcgcctgccgcagcgctattggcagatgcgcccgctgtttctggaactgctgggcaaccatgcgcagtgcccgtatggcgtgctgctgaaaacccattgcccgctgcgcgcggcggtgaccccggcggcgggcgtgtgcgcgcgcgaaaaaccgcagggcagcgtggcggcgccggaagaagaagataccgatccgcgccgcctggtgcagctgctgcgccagcatagcagcccgtggcaggtgtatggctttgtgcgcgcgtgcctgcgccgcctggtgccgccgggcctgtggggcagccgccataacgaacgccgctttctgcgcaacaccaaaaaatttattagcctgggcaaacatgcgaaactgagcctgcaggaactgacctggaaaatgagcgtgcgcgattgcgcgtggctgcgccgcagcccgggcgtgggctgcgtgccggcggcggaacatcgcctgcgcgaagaaattctggcgaaatttctgcattggctgatgagcgtgtatgtggtggaactgctgcgcagctttttttatgtgaccgaaaccacctttcagaaaaaccgcctgtttttttatcgcaaaagcgtgtggagcaaactgcagagcattggcattcgccagcatctgaaacgcgtgcagctgcgcgaactgagcgaagcggaagtgcgccagcatcgcgaagcgcgcccggcgctgctgaccagccgcctgcgctttattccgaaaccggatggcctgcgcccgattgtgaacatggattatgtggtgggcgcgcgcacctttcgccgcgaaaaacgcgcggaacgcctgaccagccgcgtgaaagcgctgtttagcgtgctgaactatgaacgcgcgcgccgcccgggcctgctgggcgcgagcgtgctgggcctggatgatattcatcgcgcgtggcgcacctttgtgctgcgcgtgcgcgcgcaggatccgccgccggaactgtattttgtgaaagtggatgtgaccggcgcgtatgataccattccgcaggatcgcctgaccgaagtgattgcgagcattattaaaccgcagaacacctattgcgtgcgccgctatgcggtggtgcagaaagcggcgcatggccatgtgcgcaaagcgtttaaaagccatgtgagcaccctgaccgatctgcagccgtatatgcgccagtttgtggcgcatctgcaggaaaccagcccgctgcgcgatgcggtggtgattgaacagagcagcagcctgaacgaagcgagcagcggcctgtttgatgtgtttctgcgctttatgtgccatcatgcggtgcgcattcgcggcaaaagctatgtgcagtgccagggcattccgcagggcagcattctgagcaccctgctgtgcagcctgtgctatggcgatatggaaaacaaactgtttgcgggcattcgccgcgatggcctgctgctgcgcctggtggatgattttctgctggtgaccccgcatctgacccatgcgaaaacctttctgcgcaccctggtgcgcggcgtgccggaatatggctgcgtggtgaacctgcgcaaaaccgtggtgaactttccggtggaagatgaagcgctgggcggcaccgcgtttgtgcagatgccggcgcatggcctgtttccgtggtgcggcctgctgctggatacccgcaccctggaagtgcagagcgattatagcagctatgcgcgcaccagcattcgcgcgagcctgacctttaaccgcggctttaaagcgggccgcaacatgcgccgcaaactgtttggcgtgctgcgcctgaaatgccatagcctgtttctggatctgcaggtgaacagcctgcagaccgtgtgcaccaacatttataaaattctgctgctgcaggcgtatcgctttcatgcgtgcgtgctgcagctgccgtttcatcagcaggtgtggaaaaacccgaccttttttctgcgcgtgattagcgataccgcgagcctgtgctatagcattctgaaagcgaaaaacgcgggcatgagcctgggcgcgaaaggcgcggcgggcccgctgccgagcgaagcggtgcagtggctgtgccatcaggcgtttctgctgaaactgacccgccatcgcgtgacctatgtgccgctgctgggcagcctgcgcaccgcgcagacccagctgagccgcaaactgccgggcaccaccctgaccgcgctggaagcggcggcgaacccggcgctgccgagcgattttaaaaccattctggat

SEQ ID NO: 639 - DNA, 3396 bp; single-stranded, linear
  - 1..3396: /note= "hTRT-encoding sequence employing alternative codon distributions for enteric bacteria (high expressing genes)"
atgccgcgtgctccgcgttgccgtgctgttcgttccctgctgcgttcccactaccgtgaagttctgccgctggctaccttcgttcgtcgtctgggtccgcagggttggcgtctggttcagcgtggtgacccggctgctttccgtgctctggttgctcagtgcctggtttgcgttccgtgggacgctcgtccgccgccggctgctccgtccttccgtcaggtttcctgcctgaaagaactggttgctcgtgttctgcagcgtctgtgcgaacgtggtgctaaaaacgttctggctttcggtttcgctctgctggacggtgctcgtggtggtccgccggaagctttcaccacctccgttcgttcctacctgccgaacaccgttaccgacgctctgcgtggttccggtgcttggggtctgctgctgcgtcgtgttggtgacgacgttctggttcacctgctggctcgttgcgctctgttcgttctggttgctccgtcctgcgcttaccaggtttgcggtccgccgctgtaccagctgggtgctgctacccaggctcgtccgccgccgcacgcttccggtccgcgtcgtcgtctgggttgcgaacgtgcttggaaccactccgttcgtgaagctggtgttccgctgggtctgccggctccgggtgctcgtcgtcgtggtggttccgcttcccgttccctgccgctgccgaaacgtccgcgtcgtggtgctgctccggaaccggaacgtaccccggttggtcagggttcctgggctcacccgggtcgtacccgtggtccgtccgaccgtggtttctgcgttgtttccccggctcgtccggctgaagaagctacctccctggaaggtgctctgtccggtacccgtcactcccacccgtccgttggtcgtcagcaccacgctggtccgccgtccacctcccgtccgccgcgtccgtgggacaccccgtgcccgccggtttacgctgaaaccaaacacttcctgtactcctccggtgacaaagaacagctgcgtccgtccttcctgctgtcctccctgcgtccgtccctgaccggtgctcgtcgtctggttgaaaccatcttcctgggttcccgtccgtggatgccgggtaccccgcgtcgtctgccgcgtctgccgcagcgttactggcagatgcgtccgctgttcctggaactgctgggtaaccacgctcagtgcccgtacggtgttctgctgaaaacccactgcccgctgcgtgctgctgttaccccggctgctggtgtttgcgctcgtgaaaaaccgcagggttccgttgctgctccggaagaagaagacaccgacccgcgtcgtctggttcagctgctgcgtcagcactcctccccgtggcaggtttacggtttcgttcgtgcttgcctgcgtcgtctggttccgccgggtctgtggggttcccgtcacaacgaacgtcgtttcctgcgtaacaccaaaaaattcatctccctgggtaaacacgctaaactgtccctgcaggaactgacctggaaaatgtccgttcgtgactgcgcttggctgcgtcgttccccgggtgttggttgcgttccggctgctgaacaccgtctgcgtgaagaaatcctggctaaattcctgcactggctgatgtccgtttacgttgttgaactgctgcgttccttcttctacgttaccgaaaccaccttccagaaaaaccgtctgttcttctaccgtaaatccgtttggtccaaactgcagtccatcggtatccgtcagcacctgaaacgtgttcagctgcgtgaactgtccgaagctgaagttcgtcagcaccgtgaagctcgtccggctctgctgacctcccgtctgcgtttcatcccgaaaccggacggtctgcgtccgatcgttaacatggactacgttgttggtgctcgtaccttccgtcgtgaaaaacgtgctgaacgtctgacctcccgtgttaaagctctgttctccgttctgaactacgaacgtgctcgtcgtccgggtctgctgggtgcttccgttctgggtctggacgacatccaccgtgcttggcgtaccttcgttctgcgtgttcgtgctcaggacccgccgccggaactgtacttcgttaaagttgacgttaccggtgcttacgacaccatcccgcaggaccgtctgaccgaagttatcgcttccatcatcaaaccgcagaacacctactgcgttcgtcgttacgctgttgttcagaaagctgctcacggtcacgttcgtaaagctttcaaatcccacgtttccaccctgaccgacctgcagccgtacatgcgtcagttcgttgctcacctgcaggaaacctccccgctgcgtgacgctgttgttatcgaacagtcctcctccctgaacgaagcttcctccggtctgttcgacgttttcctgcgtttcatgtgccaccacgctgttcgtatccgtggtaaatcctacgttcagtgccagggtatcccgcagggttccatcctgtccaccctgctgtgctccctgtgctacggtgacatggaaaacaaactgttcgctggtatccgtcgtgacggtctgctgctgcgtctggttgacgacttcctgctggttaccccgcacctgacccacgctaaaaccttcctgcgtaccctggttcgtggtgttccggaatacggttgcgttgttaacctgcgtaaaaccgttgttaacttcccggttgaagacgaagctctgggtggtaccgctttcgttcagatgccggctcacggtctgttcccgtggtgcggtctgctgctggacacccgtaccctggaagttcagtccgactactcctcctacgctcgtacctccatccgtgcttccctgaccttcaaccgtggtttcaaagctggtcgtaacatgcgtcgtaaactgttcggtgttctgcgtctgaaatgccactccctgttcctggacctgcaggttaactccctgcagaccgtttgcaccaacatctacaaaatcctgctgctgcaggcttaccgtttccacgcttgcgttctgcagctgccgttccaccagcaggtttggaaaaacccgaccttcttcctgcgtgttatctccgacaccgcttccctgtgctactccatcctgaaagctaaaaacgctggtatgtccctgggtgctaaaggtgctgctggtccgctgccgtccgaagctgttcagtggctgtgccaccaggctttcctgctgaaactgacccgtcaccgtgttacctacgttccgctgctgggttccctgcgtaccgctcagacccagctgtcccgtaaactgccgggtaccaccctgaccgctctggaagctgctgctaacccggctctgccgtccgacttcaaaaccatcctggac

SEQ ID NO: 640 - DNA, 3396 bp; single-stranded, linear
  - 1..3396: /note= "hTRT-encoding sequence employing alternative codon distributions for yeast (all genes)"
atgccaagagctccaagatgtagagctgttagatctttgttgagatctcattatagagaagttttgccattggctacttttgttagaagattgggtccacaaggttggagattggttcaaagaggtgatccagctgcttttagagctttggttgctcaatgtttggtttgtgttccatgggatgctagaccaccaccagctgctccatcttttagacaagtttcttgtttgaaagaattggttgctagagttttgcaaagattgtgtgaaagaggtgctaaaaatgttttggcttttggttttgctttgttggatggtgctagaggtggtccaccagaagcttttactacttctgttagatcttatttgccaaatactgttactgatgctttgagaggttctggtgcttggggtttgttgttgagaagagttggtgatgatgttttggttcatttgttggctagatgtgctttgtttgttttggttgctccatcttgtgcttatcaagtttgtggtccaccattgtatcaattgggtgctgctactcaagctagaccaccaccacatgcttctggtccaagaagaagattgggttgtgaaagagcttggaatcattctgttagagaagctggtgttccattgggtttgccagctccaggtgctagaagaagaggtggttctgcttctagatctttgccattgccaaaaagaccaagaagaggtgctgctccagaaccagaaagaactccagttggtcaaggttcttgggctcatccaggtagaactagaggtccatctgatagaggtttttgtgttgtttctccagctagaccagctgaagaagctacttctttggaaggtgctttgtctggtactagacattctcatccatctgttggtagacaacatcatgctggtccaccatctacttctagaccaccaagaccatgggatactccatgtccaccagtttatgctgaaactaaacattttttgtattcttctggtgataaagaacaattgagaccatcttttttgttgtcttctttgagaccatctttgactggtgctagaagattggttgaaactatttttttgggttctagaccatggatgccaggtactccaagaagattgccaagattgccacaaagatattggcaaatgagaccattgtttttggaattgttgggtaatcatgctcaatgtccatatggtgttttgttgaaaactcattgtccattgagagctgctgttactccagctgctggtgtttgtgctagagaaaaaccacaaggttctgttgctgctccagaagaagaagatactgatccaagaagattggttcaattgttgagacaacattcttctccatggcaagtttatggttttgttagagcttgtttgagaagattggttccaccaggtttgtggggttctagacataatgaaagaagatttttgagaaatactaaaaaatttatttctttgggtaaacatgctaaattgtctttgcaagaattgacttggaaaatgtctgttagagattgtgcttggttgagaagatctccaggtgttggttgtgttccagctgctgaacatagattgagagaagaaattttggctaaatttttgcattggttgatgtctgtttatgttgttgaattgttgagatcttttttttatgttactgaaactacttttcaaaaaaatagattgtttttttatagaaaatctgtttggtctaaattgcaatctattggtattagacaacatttgaaaagagttcaattgagagaattgtctgaagctgaagttagacaacatagagaagctagaccagctttgttgacttctagattgagatttattccaaaaccagatggtttgagaccaattgttaatatggattatgttgttggtgctagaacttttagaagagaaaaaagagctgaaagattgacttctagagttaaagctttgttttctgttttgaattatgaaagagctagaagaccaggtttgttgggtgcttctgttttgggtttggatgatattcatagagcttggagaacttttgttttgagagttagagctcaagatccaccaccagaattgtattttgttaaagttgatgttactggtgcttatgatactattccacaagatagattgactgaagttattgcttctattattaaaccacaaaatacttattgtgttagaagatatgctgttgttcaaaaagctgctcatggtcatgttagaaaagcttttaaatctcatgtttctactttgactgatttgcaaccatatatgagacaatttgttgctcatttgcaagaaacttctccattgagagatgctgttgttattgaacaatcttcttctttgaatgaagcttcttctggtttgtttgatgtttttttgagatttatgtgtcatcatgctgttagaattagaggtaaatcttatgttcaatgtcaaggtattccacaaggttctattttgtctactttgttgtgttctttgtgttatggtgatatggaaaataaattgtttgctggtattagaagagatggtttgttgttgagattggttgatgattttttgttggttactccacatttgactcatgctaaaacttttttgagaactttggttagaggtgttccagaatatggttgtgttgttaatttgagaaaaactgttgttaattttccagttgaagatgaagctttgggtggtactgcttttgttcaaatgccagctcatggtttgtttccatggtgtggtttgttgttggatactagaactttggaagttcaatctgattattcttcttatgctagaacttctattagagcttctttgacttttaatagaggttttaaagctggtagaaatatgagaagaaaattgtttggtgttttgagattgaaatgtcattctttgtttttggatttgcaagttaattctttgcaaactgtttgtactaatatttataaaattttgttgttgcaagcttatagatttcatgcttgtgttttgcaattgccatttcatcaacaagtttggaaaaatccaactttttttttgagagttatttctgatactgcttctttgtgttattctattttgaaagctaaaaatgctggtatgtctttgggtgctaaaggtgctgctggtccattgccatctgaagctgttcaatggttgtgtcatcaagcttttttgttgaaattgactagacatagagttacttatgttccattgttgggttctttgagaactgctcaaactcaattgtctagaaaattgccaggtactactttgactgctttggaagctgctgctaatccagctttgccatctgattttaaaactattttggat

SEQ ID NO: 641 - DNA, 3396 bp; single-stranded, linear
  - 1..3396: /note= "hTRT-encoding sequence employing alternative codon distributions for yeast (high expressing genes)"
atgccaagagctccaagatgtagagctgttagatctttgttgagatctcactacagagaagttttgccattggctactttcgttagaagattgggtccacaaggttggagattggttcaaagaggtgacccagctgctttcagagctttggttgctcaatgtttggtttgtgttccatgggacgctagaccaccaccagctgctccatctttcagacaagtttcttgtttgaaggaattggttgctagagttttgcaaagattgtgtgaaagaggtgctaagaacgttttggctttcggtttcgctttgttggacggtgctagaggtggtccaccagaagctttcactacttctgttagatcttacttgccaaacactgttactgacgctttgagaggttctggtgcttggggtttgttgttgagaagagttggtgacgacgttttggttcacttgttggctagatgtgctttgttcgttttggttgctccatcttgtgcttaccaagtttgtggtccaccattgtaccaattgggtgctgctactcaagctagaccaccaccacacgcttctggtccaagaagaagattgggttgtgaaagagcttggaaccactctgttagagaagctggtgttccattgggtttgccagctccaggtgctagaagaagaggtggttctgcttctagatctttgccattgccaaagagaccaagaagaggtgctgctccagaaccagaaagaactccagttggtcaaggttcttgggctcacccaggtagaactagaggtccatctgacagaggtttctgtgttgtttctccagctagaccagctgaagaagctacttctttggaaggtgctttgtctggtactagacactctcacccatctgttggtagacaacaccacgctggtccaccatctacttctagaccaccaagaccatgggacactccatgtccaccagtttacgctgaaactaagcacttcttgtactcttctggtgacaaggaacaattgagaccatctttcttgttgtcttctttgagaccatctttgactggtgctagaagattggttgaaactattttcttgggttctagaccatggatgccaggtactccaagaagattgccaagattgccacaaagatactggcaaatgagaccattgttcttggaattgttgggtaaccacgctcaatgtccatacggtgttttgttgaagactcactgtccattgagagctgctgttactccagctgctggtgtttgtgctagagaaaagccacaaggttctgttgctgctccagaagaagaagacactgacccaagaagattggttcaattgttgagacaacactcttctccatggcaagtttacggtttcgttagagcttgtttgagaagattggttccaccaggtttgtggggttctagacacaacgaaagaagattcttgagaaacactaagaagttcatttctttgggtaagcacgctaagttgtctttgcaagaattgacttggaagatgtctgttagagactgtgcttggttgagaagatctccaggtgttggttgtgttccagctgctgaacacagattgagagaagaaattttggctaagttcttgcactggttgatgtctgtttacgttgttgaattgttgagatctttcttctacgttactgaaactactttccaaaagaacagattgttcttctacagaaagtctgtttggtctaagttgcaatctattggtattagacaacacttgaagagagttcaattgagagaattgtctgaagctgaagttagacaacacagagaagctagaccagctttgttgacttctagattgagattcattccaaagccagacggtttgagaccaattgttaacatggactacgttgttggtgctagaactttcagaagagaaaagagagctgaaagattgacttctagagttaaggctttgttctctgttttgaactacgaaagagctagaagaccaggtttgttgggtgcttctgttttgggtttggacgacattcacagagcttggagaactttcgttttgagagttagagctcaagacccaccaccagaattgtacttcgttaaggttgacgttactggtgcttacgacactattccacaagacagattgactgaagttattgcttctattattaagccacaaaacacttactgtgttagaagatacgctgttgttcaaaaggctgctcacggtcacgttagaaaggctttcaagtctcacgtttctactttgactgacttgcaaccatacatgagacaattcgttgctcacttgcaagaaacttctccattgagagacgctgttgttattgaacaatcttcttctttgaacgaagcttcttctggtttgttcgacgttttcttgagattcatgtgtcaccacgctgttagaattagaggtaagtcttacgttcaatgtcaaggtattccacaaggttctattttgtctactttgttgtgttctttgtgttacggtgacatggaaaacaagttgttcgctggtattagaagagacggtttgttgttgagattggttgacgacttcttgttggttactccacacttgactcacgctaagactttcttgagaactttggttagaggtgttccagaatacggttgtgttgttaacttgagaaagactgttgttaacttcccagttgaagacgaagctttgggtggtactgctttcgttcaaatgccagctcacggtttgttcccatggtgtggtttgttgttggacactagaactttggaagttcaatctgactactcttcttacgctagaacttctattagagcttctttgactttcaacagaggtttcaaggctggtagaaacatgagaagaaagttgttcggtgttttgagattgaagtgtcactctttgttcttggacttgcaagttaactctttgcaaactgtttgtactaacatttacaagattttgttgttgcaagcttacagattccacgcttgtgttttgcaattgccattccaccaacaagtttggaagaacccaactttcttcttgagagttatttctgacactgcttctttgtgttactctattttgaaggctaagaacgctggtatgtctttgggtgctaagggtgctgctggtccattgccatctgaagctgttcaatggttgtgtcaccaagctttcttgttgaagttgactagacacagagttacttacgttccattgttgggttctttgagaactgctcaaactcaattgtctagaaagttgccaggtactactttgactgctttggaagctgctgctaacccagctttgccatctgacttcaagactattttggac

SEQ ID NO: 642 - DNA, 3396 bp; single-stranded, linear
  - 1..3396: /note= ""generic" hTRT protein encoding sequence"
atgccacgtgccccacgttgtcgtgccgttcgttctttgttgcgttctcactaccgtgaagttttgccattggccaccttcgttcgtcgtttgggtccacaaggttggcgtttggttcaacgtggtgatccagccgccttccgtgccttggttgcccaatgtttggtttgtgttccatgggatgcccgtccaccaccagccgccccatctttccgtcaagtttcttgtttgaaagaattggttgcccgtgttttgcaacgtttgtgtgaacgtggtgccaaaaacgttttggccttcggtttcgccttgttggatggtgcccgtggtggtccaccagaagccttcaccacctctgttcgttcttacttgccaaacaccgttaccgatgccttgcgtggttctggtgcctggggtttgttgttgcgtcgtgttggtgatgatgttttggttcacttgttggcccgttgtgccttgttcgttttggttgccccatcttgtgcctaccaagtttgtggtccaccattgtaccaattgggtgccgccacccaagcccgtccaccaccacacgcctctggtccacgtcgtcgtttgggttgtgaacgtgcctggaaccactctgttcgtgaagccggtgttccattgggtttgccagccccaggtgcccgtcgtcgtggtggttctgcctctcgttctttgccattgccaaaacgtccacgtcgtggtgccgccccagaaccagaacgtaccccagttggtcaaggttcttgggcccacccaggtcgtacccgtggtccatctgatcgtggtttctgtgttgtttctccagcccgtccagccgaagaagccacctctttggaaggtgccttgtctggtacccgtcactctcacccatctgttggtcgtcaacaccacgccggtccaccatctacctctcgtccaccacgtccatgggataccccatgtccaccagtttacgccgaaaccaaacacttcttgtactcttctggtgataaagaacaattgcgtccatctttcttgttgtcttctttgcgtccatctttgaccggtgcccgtcgtttggttgaaaccattttcttgggttctcgtccatggatgccaggtaccccacgtcgtttgccacgtttgccacaacgttactggcaaatgcgtccattgttcttggaattgttgggtaaccacgcccaatgtccatacggtgttttgttgaaaacccactgtccattgcgtgccgccgttaccccagccgccggtgtttgtgcccgtgaaaaaccacaaggttctgttgccgccccagaagaagaagataccgatccacgtcgtttggttcaattgttgcgtcaacactcttctccatggcaagtttacggtttcgttcgtgcctgtttgcgtcgtttggttccaccaggtttgtggggttctcgtcacaacgaacgtcgtttcttgcgtaacaccaaaaaattcatttctttgggtaaacacgccaaattgtctttgcaagaattgacctggaaaatgtctgttcgtgattgtgcctggttgcgtcgttctccaggtgttggttgtgttccagccgccgaacaccgtttgcgtgaagaaattttggccaaattcttgcactggttgatgtctgtttacgttgttgaattgttgcgttctttcttctacgttaccgaaaccaccttccaaaaaaaccgtttgttcttctaccgtaaatctgtttggtctaaattgcaatctattggtattcgtcaacacttgaaacgtgttcaattgcgtgaattgtctgaagccgaagttcgtcaacaccgtgaagcccgtccagccttgttgacctctcgtttgcgtttcattccaaaaccagatggtttgcgtccaattgttaacatggattacgttgttggtgcccgtaccttccgtcgtgaaaaacgtgccgaacgtttgacctctcgtgttaaagccttgttctctgttttgaactacgaacgtgcccgtcgtccaggtttgttgggtgcctctgttttgggtttggatgatattcaccgtgcctggcgtaccttcgttttgcgtgttcgtgcccaagatccaccaccagaattgtacttcgttaaagttgatgttaccggtgcctacgataccattccacaagatcgtttgaccgaagttattgcctctattattaaaccacaaaacacctactgtgttcgtcgttacgccgttgttcaaaaagccgcccacggtcacgttcgtaaagccttcaaatctcacgtttctaccttgaccgatttgcaaccatacatgcgtcaattcgttgcccacttgcaagaaacctctccattgcgtgatgccgttgttattgaacaatcttcttctttgaacgaagcctcttctggtttgttcgatgttttcttgcgtttcatgtgtcaccacgccgttcgtattcgtggtaaatcttacgttcaatgtcaaggtattccacaaggttctattttgtctaccttgttgtgttctttgtgttacggtgatatggaaaacaaattgttcgccggtattcgtcgtgatggtttgttgttgcgtttggttgatgatttcttgttggttaccccacacttgacccacgccaaaaccttcttgcgtaccttggttcgtggtgttccagaatacggttgtgttgttaacttgcgtaaaaccgttgttaacttcccagttgaagatgaagccttgggtggtaccgccttcgttcaaatgccagcccacggtttgttcccatggtgtggtttgttgttggatacccgtaccttggaagttcaatctgattactcttcttacgcccgtacctctattcgtgcctctttgaccttcaaccgtggtttcaaagccggtcgtaacatgcgtcgtaaattgttcggtgttttgcgtttgaaatgtcactctttgttcttggatttgcaagttaactctttgcaaaccgtttgtaccaacatttacaaaattttgttgttgcaagcctaccgtttccacgcctgtgttttgcaattgccattccaccaacaagtttggaaaaacccaaccttcttcttgcgtgttatttctgataccgcctctttgtgttactctattttgaaagccaaaaacgccggtatgtctttgggtgccaaaggtgccgccggtccattgccatctgaagccgttcaatggttgtgtcaccaagccttcttgttgaaattgacccgtcaccgtgttacctacgttccattgttgggttctttgcgtaccgcccaaacccaattgtctcgtaaattgccaggtaccaccttgaccgccttggaagccgccgccaacccagccttgccatctgatttcaaaaccattttggat

SEQ ID NO: 643 - DNA, 100 bp; single-stranded, linear
  - 1..100: /note= "oligonucleotide 1B"
ccagcggcagaacttcgcgatagtgggaacgcagcagggaacgaacagcacggcaacgcggagcacgcggcatatggtcgactctagagctcccgcgtgc

SEQ ID NO: 644 - DNA, 90 bp; single-stranded, linear
  - 1..90: /note= "oligonucleotide 1T"
gcacgcgggagctctagagtcgaccatatgccgcgtgctccgcgttgccgtgctgttcgttccctgctgcgttcccactatcgcgaagtt

SEQ ID NO: 645 - DNA, 90 bp; single-stranded, linear
  - 1..90: /note= "oligonucleotide 2B"
ggcactgagcaaccagagcacggaaagcagccgggtcaccacgctgaaccagacgccaaccctgcgggcccagacgacgaacgaaggtag

SEQ ID NO: 646 - DNA, 90 bp; single-stranded, linear
  - 1..90: /note= "oligonucleotide 2T"
ctgccgctggctaccttcgttcgtcgtctgggcccgcagggttggcgtctggttcagcgtggtgacccggctgctttccgtgctctggtt

SEQ ID NO: 647 - DNA, 90 bp; single-stranded, linear
  - 1..90: /note= "oligonucleotide 3B"
gaacacgagcaaccagttctttcaggcaggaaacctgacggaaggacggagcagccggcggcggacgagcgtcccacggaacgcaaacca

SEQ ID NO: 648 - DNA, 90 bp; single-stranded, linear
  - 1..90: /note= "oligonucleotide 3T"
gctcagtgcctggtttgcgttccgtgggacgctcgtccgccgccggctgctccgtccttccgtcaggtttcctgcctgaaagaactggtt

SEQ ID NO: 649 - DNA, 90 bp; single-stranded, linear
  - 1..90: /note= "oligonucleotide 4B"
atgcttccggcggaccaccacgagcaccgtccagcagagcgaaaccgaaagccagaacgtttttagcaccacgttcgcacagacgctgca

SEQ ID NO: 650 - DNA, 90 bp; single-stranded, linear
  - 1..90: /note= "oligonucleotide 4T"
gctcgtgttctgcagcgtctgtgcgaacgtggtgctaaaaacgttctggctttcggtttcgctctgctggacggtgctcgtggtggtccg

SEQ ID NO: 651 - DNA, 90 bp; single-stranded, linear
  - 1..90: /note= "oligonucleotide 5B"
caacacgacgcagcagcagaccccaagcaccggaaccacgcagagcgtcggtaacggtgttcggcaggtaggaacgaacggaggtggtga

SEQ ID NO: 652 - DNA, 90 bp; single-stranded, linear
  - 1..90: /note= "oligonucleotide 5T"
ccggaagcattcaccacctccgttcgttcctacctgccgaacaccgttaccgacgctctgcgtggttccggtgcttggggtctgctgctg

SEQ ID NO: 653 - DNA, 90 bp; single-stranded, linear
  - 1..90: /note= "oligonucleotide 6B"
gcggcggaccacaaacctggtaagcgcaggacggagcaaccagaacgaacagagcgcaacgagccagcaggtgaaccagaacgtcgtcac

SEQ ID NO: 654 - DNA, 90 bp; single-stranded, linear
  - 1..90: /note= "oligonucleotide 6T"
cgtcgtgttggtgacgacgttctggttcacctgctggctcgttgcgctctgttcgttctggttgctccgtcctgcgcttaccaggtttgt

SEQ ID NO: 655 - DNA, 90 bp; single-stranded, linear
  - 1..90: /note= "oligonucleotide 7B"
ggttccaagcacgttcgcaacccagacgacgacgcggaccggaagcgtgcggcggcggacgagcctgggtagcagcacccagctggtaca

SEQ ID NO: 656 - DNA, 90 bp; single-stranded, linear
  - 1..90: /note= "oligonucleotide 7T"
ggtccgccgctgtaccagctgggtgctgctacccaggctcgtccgccgccgcacgcttccggtccgcgtcgtcgtctgggttgcgaacgt

SEQ ID NO: 657 - DNA, 90 bp; single-stranded, linear
  - 1..90: /note= "oligonucleotide 8B"
gcagcggcagggaacgggaagcggaaccaccacgacgacgagcacccggagccggcagacccagcggaacaccagcttcacgaacggagt

SEQ ID NO: 658 - DNA, 90 bp; single-stranded, linear
  - 1..90: /note= "oligonucleotide 8T"
gcttggaaccactccgttcgtgaagctggtgttccgctgggtctgccggctccgggtgctcgtcgtcgtggtggttccgcttcccgttcc

SEQ ID NO: 659 - DNA, 90 bp; single-stranded, linear
  - 1..90: /note= "oligonucleotide 9B"
gaccacgggtacgacccgggtgagcccaggaaccctgaccaaccggggtacgttccggttccggagcagcaccacgacgcggacgtttcg

SEQ ID NO: 660 - DNA, 90 bp; single-stranded, linear
  - 1..90: /note= "oligonucleotide 9T"
ctgccgctgccgaaacgtccgcgtcgtggtgctgctccggaaccggaacgtaccccggttggtcagggttcctgggctcacccgggtcgt

SEQ ID NO: 661 - DNA (<Unknown>), 90 bp; single-stranded, linear
  - 1..90: /note= "oligonucleotide 10B"
agtgacgggtgccggacagagcaccttccagggaggtagcttcttcagccggacgagccggggaaacaacgcagaaaccacggtcggacg

SEQ ID NO: 662 - DNA (<Unknown>), 90 bp; single-stranded, linear
  - 1..90: /note= "oligonucleotide 10T"
acccgtggtccgtccgaccgtggtttctgcgttgtttccccggctcgtccggctgaagaagctacctccctggaaggtgctctgtccggc

SEQ ID NO: 663 - DNA (<Unknown>), 90 bp; single-stranded, linear
  - 1..90: /note= "oligonucleotide 11B"
aaaccggcgggcacggggtgtcccacggacgcggcggacgggaggtggacggcggaccagcgtggtgctgacgaccaacggacgggtggg

SEQ ID NO: 664 - DNA (<Unknown>), 90 bp; single-stranded, linear
  - 1..90: /note= "oligonucleotide 11T"
acccgtcactcccacccgtccgttggtcgtcagcaccacgctggtccgccgtccacctcccgtccgccgcgtccgtgggacaccccgtgc

SEQ ID NO: 665 - DNA, 90 bp; single-stranded, linear
  - 1..90: /note= "oligonucleotide 12B"
tcagggacggacgcagggaggacagcaggaaggacggacgcagctgttctttgtcaccggaggagtacaggaagtgtttggtttcagcgt

SEQ ID NO: 666 - DNA, 90 bp; single-stranded, linear
  - 1..90: /note= "oligonucleotide 12T"
ccgccggtttacgctgaaaccaaacacttcctgtactcctccggtgacaaagaacagctgcgtccgtccttcctgctgtcctccctgcgt

SEQ ID NO: 667 - DNA, 90 bp; single-stranded, linear
  - 1..90: /note= "oligonucleotide 13B"
gctgcggcagacgcggcagacgacgcggggtgcccggcatccacggacgggaacccaggaagatagtttcaaccagacgacgagcaccgg

SEQ ID NO: 668 - DNA, 90 bp; single-stranded, linear
  - 1..90: /note= "oligonucleotide 13T"
ccgtccctgaccggtgctcgtcgtctggttgaaactatcttcctgggttcccgtccgtggatgccgggcaccccgcgtcgtctgccgcgt

SEQ ID NO: 669 - DNA, 90 bp; single-stranded, linear
  - 1..90: /note= "oligonucleotide 14B"
gcgggcagtgggttttcagcagaacaccatacgggcactgagcgtggttgcccagcagttccaggaacagcggacgcatctgccagtaac

SEQ ID NO: 670 - DNA, 90 bp; single-stranded, linear
  - 1..90: /note= "oligonucleotide 14T"
ctgccgcagcgttactggcagatgcgtccgctgttcctggaactgctgggcaaccacgctcagtgcccgtatggtgttctgctgaaaacc

SEQ ID NO: 671 - DNA, 90 bp; single-stranded, linear
  - 1..90: /note= "oligonucleotide 15B"
ggtcggtatcttcttcttccggagcagcaacggaaccctgcggtttttcacgagcgcaaacaccagcagccggggtaacagcagcacgca

SEQ ID NO: 672 - DNA, 90 bp; single-stranded, linear
  - 1..90: /note= "oligonucleotide 15T"
cactgcccgctgcgtgctgctgttaccccggctgctggtgtttgcgctcgtgaaaaaccgcagggttccgttgctgctccggaagaagaa

SEQ ID NO: 673 - DNA, 90 bp; single-stranded, linear
  - 1..90: /note= "oligonucleotide 16B"
gcggaaccagacgacgcaggcatgcacgaacgaaaccgtaaacctgccacggggaggagtgctgacgcagcagctgaaccagacgacgcg

SEQ ID NO: 674 - DNA, 90 bp; single-stranded, linear
  - 1..90: /note= "oligonucleotide 16T"
gataccgacccgcgtcgtctggttcagctgctgcgtcagcactcctccccgtggcaggtttacggtttcgttcgtgcatgcctgcgtcgt

SEQ ID NO: 675 - DNA, 90 bp; single-stranded, linear
  - 1..90: /note= "oligonucleotide 17B"
gggacagtttagcgtgtttacccagggagatgaattttttggtgttacgcaggaaacgacgttcgttgtgacgggaaccccacagacccg

SEQ ID NO: 676 - DNA, 90 bp; single-stranded, linear
  - 1..90: /note= "oligonucleotide 17T"
ctggttccgccgggtctgtggggttcccgtcacaacgaacgtcgtttcctgcgtaacaccaaaaaattcatctccctgggtaaacacgct

SEQ ID NO: 677 - DNA, 90 bp; single-stranded, linear
  - 1..90: /note= "oligonucleotide 18B"
ggtgttcagcagccggaacgcaaccaacacccggagaacgacgcagccaagcgcagtcacgaacggacattttccaggtcagttcctgca

SEQ ID NO: 678 - DNA, 90 bp; single-stranded, linear
  - 1..90: /note= "oligonucleotide 18T"
aaactgtccctgcaggaactgacctggaaaatgtccgttcgtgactgcgcttggctgcgtcgttctccgggtgttggttgcgttccggct

SEQ ID NO: 679 - DNA, 90 bp; single-stranded, linear
  - 1..90: /note= "oligonucleotide 19B"
cggtaacgtagaagaaggaacgcagcagttcaacaacgtatacggacatcagccagtgcaggaatttagccaggatttcttcacgcagac

SEQ ID NO: 680 - DNA, 90 bp; single-stranded, linear
  - 1..90: /note= "oligonucleotide 19T"
gctgaacaccgtctgcgtgaagaaatcctggctaaattcctgcactggctgatgtccgtatacgttgttgaactgctgcgttccttcttc

SEQ ID NO: 681 - DNA, 90 bp; single-stranded, linear
  - 1..90: /note= "oligonucleotide 20B"
gtttcaggtgctgacggataccgatggactgcagtttggaccaaacggatttacggtagaagaacagacggtttttctggaaggtggttt

SEQ ID NO: 682 - DNA, 90 bp; single-stranded, linear
  - 1..90: /note= "oligonucleotide 20T"
tacgttaccgaaaccaccttccagaaaaaccgtctgttcttctaccgtaaatccgtttggtccaaactgcagtccatcggtatccgtcag

SEQ ID NO: 683 - DNA, 89 bp; single-stranded, linear
  - 1..89: /note= "oligonucleotide 21B"
gatgaaacgcagacgggaggtcagcagagccggacgagcttcacggtgctgacgaacttcagcttcggacagttcacgcagctgaacac

SEQ ID NO: 684 - DNA, 90 bp; single-stranded, linear
  - 1..90: /note= "oligonucleotide 21T"
cacctgaaacgtgttcagctgcgtgaactgtccgaagctgaagttcgtcagcaccgtgaagctcgtccggctctgctgacctcccgtctg

SEQ ID NO: 685 - DNA, 90 bp; single-stranded, linear
  - 1..90: /note= "oligonucleotide 22B"
tcagacgctcagcacgtttttcacgacggaaggtacgagcaccaacaacgtagtccatgtttacgatcggacgcagaccgtccggtttcg

SEQ ID NO: 686 - DNA, 90 bp; single-stranded, linear
  - 1..90: /note= "oligonucleotide 22T"
cgtttcatcccgaaaccggacggtctgcgtccgatcgtaaacatggactacgttgttggtgctcgtaccttccgtcgtgaaaaacgtgct

SEQ ID NO: 687 - DNA, 90 bp; single-stranded, linear
  - 1..90: /note= "oligonucleotide 23B"
cgtccagacccagaacggaagcacccagcagacccggacgacgagcacgttcgtagttcagaacggagaacagagctttaacacgggagg

SEQ ID NO: 688 - DNA, 90 bp; single-stranded, linear
  - 1..90: /note= "oligonucleotide 23T"
gagcgtctgacctcccgtgttaaagctctgttctccgttctgaactacgaacgtgctcgtcgtccgggtctgctgggtgcttccgttctg

SEQ ID NO: 689 - DNA, 90 bp; single-stranded, linear
  - 1..90: /note= "oligonucleotide 24B"
cggtaacgtcaactttaacgaagtacagttccggcggcgggtcctgagcacgaacacgcagaacgaaggtacgccaagcacggtggatgt

SEQ ID NO: 690 - DNA, 90 bp; single-stranded, linear
  - 1..90: /note= "oligonucleotide 24T"
ggtctggacgacatccaccgtgcttggcgtaccttcgttctgcgtgttcgtgctcaggacccgccgccggaactgtacttcgttaaagtt

SEQ ID NO: 691 - DNA, 90 bp; single-stranded, linear
  - 1..90: /note= "oligonucleotide 25B"
cgtaacgacgaacgcagtaggtgttctgcggtttgatgatggaagcgataacttcggtcagacggtcctgcgggatggtgtcgtacgcgc

SEQ ID NO: 692 - DNA, 90 bp; single-stranded, linear
  - 1..90: /note= "oligonucleotide 25T"
gacgttaccggcgcgtacgacaccatcccgcaggaccgtctgaccgaagttatcgcttccatcatcaaaccgcagaacacctactgcgtt

SEQ ID NO: 693 - DNA, 90 bp; single-stranded, linear
  - 1..90: /note= "oligonucleotide 26B"
gacgcatgtacggctgcaggtcggtcagggtggaaacgtgggatttgaatgctttacgaacgtgaccgtgagcagctttctgaacaacag

SEQ ID NO: 694 - DNA, 90 bp; single-stranded, linear
  - 1..90: /note= "oligonucleotide 26T"
cgtcgttacgctgttgttcagaaagctgctcacggtcacgttcgtaaagcattcaaatcccacgtttccaccctgaccgacctgcagccg

SEQ ID NO: 695 - DNA, 90 bp; single-stranded, linear
  - 1..90: /note= "oligonucleotide 27B"
gaccggaggaagcttcgttcagggaggaggactgttcgataacaacagcgtcacgcagcggggaggtttcctgcaggtgagcaacgaact

SEQ ID NO: 696 - DNA, 90 bp; single-stranded, linear
  - 1..90: /note= "oligonucleotide 27T"
tacatgcgtcagttcgttgctcacctgcaggaaacctccccgctgcgtgacgctgttgttatcgaacagtcctcctccctgaacgaagct

SEQ ID NO: 697 - DNA, 90 bp; single-stranded, linear
  - 1..90: /note= "oligonucleotide 28B"
aaccctgcgggataccctggcactgaacgtaggatttaccacggatacgaacagcgtggtggcacatgaaacgcaggaaaacgtcgaaca

SEQ ID NO: 698 - DNA, 90 bp; single-stranded, linear
  - 1..90: /note= "oligonucleotide 28T"
tcctccggtctgttcgacgttttcctgcgtttcatgtgccaccacgctgttcgtatccgtggtaaatcctacgttcagtgccagggtatc

SEQ ID NO: 699 - DNA, 90 bp; single-stranded, linear
  - 1..90: /note= "oligonucleotide 29B"
gcagcagcagaccgtcacgacggataccagcgaacagtttgttttccatgtcaccgtagcacagggagcacagcagggtggacaggatgg

SEQ ID NO: 700 - DNA, 90 bp; single-stranded, linear
  - 1..90: /note= "oligonucleotide 29T"
ccgcagggttccatcctgtccaccctgctgtgctccctgtgctacggtgacatggaaaacaaactgttcgctggtatccgtcgtgacggt

SEQ ID NO: 701 - DNA, 90 bp; single-stranded, linear
  - 1..90: /note= "oligonucleotide 30B"
cgtattccggaacaccacgaaccagggtacgcaggaaggttttagcgtgggtcaggtgcggagtaaccagcaggaagtcgtcaaccagac

SEQ ID NO: 702 - DNA, 90 bp; single-stranded, linear
  - 1..90: /note= "oligonucleotide 30T"
ctgctgctgcgtctggttgacgacttcctgctggttactccgcacctgacccacgctaaaaccttcctgcgtaccctggttcgtggtgtt

SEQ ID NO: 703 - DNA, 90 bp; single-stranded, linear
  - 1..90: /note= "oligonucleotide 31B"
gagccggcatctgaacgaaagcggtgccacccagagcttcgtcttcaaccgggaagttaacaacggttttacgcaggtttacaacgcaac

SEQ ID NO: 704 - DNA, 90 bp; single-stranded, linear
  - 1..90: /note= "oligonucleotide 31T"
ccggaatacggttgcgttgtaaacctgcgtaaaaccgttgttaacttcccggttgaagacgaagctctgggtggcaccgctttcgttcag

SEQ ID NO: 705 - DNA, 90 bp; single-stranded, linear
  - 1..90: /note= "oligonucleotide 32B"
ggatggaggtacgagcgtaggaggagtagtcggactgaacttccagggtacgggtgtccagcagcagaccgcaccacgggaacagaccgt

SEQ ID NO: 706 - DNA, 90 bp; single-stranded, linear
  - 1..90: /note= "oligonucleotide 32T"
atgccggctcacggtctgttcccgtggtgcggtctgctgctggacacccgtaccctggaagttcagtccgactactcctcctacgctcgt

SEQ ID NO: 707 - DNA, 90 bp; single-stranded, linear
  - 1..90: /note= "oligonucleotide 33B"
gggagtggcatttcagacgcagaacaccgaacagtttacgacgcatgttacgaccagctttgaaaccacggttgaaggtcagggaagcac

SEQ ID NO: 708 - DNA, 90 bp; single-stranded, linear
  - 1..90: /note= "oligonucleotide 33T"
acctccatccgtgcttccctgaccttcaaccgtggtttcaaagctggtcgtaacatgcgtcgtaaactgttcggtgttctgcgtctgaaa

SEQ ID NO: 709 - DNA, 90 bp; single-stranded, linear
  - 1..90: /note= "oligonucleotide 34B"
acgcgtggaaacggtaagcctgcagcagcaggattttgtagatgttggtgcaaacggtctgcagggagtttacctgcaggtccaggaaca

SEQ ID NO: 710 - DNA, 90 bp; single-stranded, linear
  - 1..90: /note= "oligonucleotide 34T"
tgccactccctgttcctggacctgcaggtaaactccctgcagaccgtttgcaccaacatctacaaaatcctgctgctgcaggcttaccgt

SEQ ID NO: 711 - DNA, 90 bp; single-stranded, linear
  - 1..90: /note= "oligonucleotide 35B"
agtagcacagggaagcggtgtcggagataacacgcaggaagaaggtcgggtttttccaaacctgctggtggaacggcagctgcagaacgc

SEQ ID NO: 712 - DNA, 90 bp; single-stranded, linear
  - 1..90: /note= "oligonucleotide 35T"
ttccacgcgtgcgttctgcagctgccgttccaccagcaggtttggaaaaacccgaccttcttcctgcgtgttatctccgacaccgcttcc

SEQ ID NO: 713 - DNA, 90 bp; single-stranded, linear
  - 1..90: /note= "oligonucleotide 36B"
ggcacagccactgaacagcttcggacggcagcggaccagcagcacctttagcacccagggacataccagcgtttttagctttcaggatgg

SEQ ID NO: 714 - DNA, 90 bp; single-stranded, linear
  - 1..90: /note= "oligonucleotide 36T"
ctgtgctactccatcctgaaagctaaaaacgctggtatgtccctgggtgctaaaggtgctgctggtccgctgccgtccgaagctgttcag

SEQ ID NO: 715 - DNA, 87 bp; single-stranded, linear
  - 1..87: /note= "oligonucleotide 37B"
acagctgggtctgagcggtacgcagggaacccagcagcggaacgtaggtaacacggtgacgggtcagtttcagcaggaaagcctggt

SEQ ID NO: 716 - DNA, 87 bp; single-stranded, linear
  - 1..87: /note= "oligonucleotide 37T"
tggctgtgccaccaggctttcctgctgaaactgacccgtcaccgtgttacctacgttccgctgctgggttccctgcgtaccgctcag

SEQ ID NO: 717 - DNA, 63 bp; single-stranded, linear
  - 1..63: /note= "oligonucleotide 38B"
acggcagagccgggttagcagcagcttccagagcggtcagggtggtacccggcagtttacggg

SEQ ID NO: 718 - DNA, 64 bp; single-stranded, linear
  - 1..64: /note= "oligonucleotide 38T"
acccagctgtcccgtaaactgccgggtaccaccctgaccgctctggaagctgctgctaacccgg

SEQ ID NO: 719 - DNA, 50 bp; single-stranded, linear
  - 1..50: /note= "oligonucleotide 39B"
gcgtgcctcgaggaattcggatccattagtccaggatggttttgaagtcg

SEQ ID NO: 720 - DNA, 60 bp; single-stranded, linear
  - 1..60: /note= "oligonucleotide 39T"
ctctgccgtccgacttcaaaaccatcctggactaatggatccgaattcctcgaggcacgc

SEQ ID NO: 721 - DNA, 3451 bp; single-stranded, linear
  - 1..3451: /note= "hTRT sequence employing codon distribution preferentially used by highly expressed genes in E. coli containing SacI and XhoI sites"
gcacgcgggagctctagagtcgaccatatgccgcgtgctccgcgttgccgtgctgttcgttccctgctgcgttcccactatcgcgaagttctgccgctggctaccttcgttcgtcgtctgggcccgcagggttggcgtctggttcagcgtggtgacccggctgctttccgtgctctggttgctcagtgcctggtttgcgttccgtgggacgctcgtccgccgccggctgctccgtccttccgtcaggtttcctgcctgaaagaactggttgctcgtgttctgcagcgtctgtgcgaacgtggtgctaaaaacgttctggctttcggtttcgctctgctggacggtgctcgtggtggtccgccggaagcattcaccacctccgttcgttcctacctgccgaacaccgttaccgacgctctgcgtggttccggtgcttggggtctgctgctgcgtcgtgttggtgacgacgttctggttcacctgctggctcgttgcgctctgttcgttctggttgctccgtcctgcgcttaccaggtttgtggtccgccgctgtaccagctgggtgctgctacccaggctcgtccgccgccgcacgcttccggtccgcgtcgtcgtctgggttgcgaacgtgcttggaaccactccgttcgtgaagctggtgttccgctgggtctgccggctccgggtgctcgtcgtcgtggtggttccgcttcccgttccctgccgctgccgaaacgtccgcgtcgtggtgctgctccggaaccggaacgtaccccggttggtcagggttcctgggctcacccgggtcgtacccgtggtccgtccgaccgtggtttctgcgttgtttccccggctcgtccggctgaagaagctacctccctggaaggtgctctgtccggcacccgtcactcccacccgtccgttggtcgtcagcaccacgctggtccgccgtccacctcccgtccgccgcgtccgtgggacaccccgtgcccgccggtttacgctgaaaccaaacacttcctgtactcctccggtgacaaagaacagctgcgtccgtccttcctgctgtcctccctgcgtccgtccctgaccggtgctcgtcgtctggttgaaactatcttcctgggttcccgtccgtggatgccgggcaccccgcgtcgtctgccgcgtctgccgcagcgttactggcagatgcgtccgctgttcctggaactgctgggcaaccacgctcagtgcccgtatggtgttctgctgaaaacccactgcccgctgcgtgctgctgttaccccggctgctggtgtttgcgctcgtgaaaaaccgcagggttccgttgctgctccggaagaagaagataccgacccgcgtcgtctggttcagctgctgcgtcagcactcctccccgtggcaggtttacggtttcgttcgtgcatgcctgcgtcgtctggttccgccgggtctgtggggttcccgtcacaacgaacgtcgtttcctgcgtaacaccaaaaaattcatctccctgggtaaacacgctaaactgtccctgcaggaactgacctggaaaatgtccgttcgtgactgcgcttggctgcgtcgttctccgggtgttggttgcgttccggctgctgaacaccgtctgcgtgaagaaatcctggctaaattcctgcactggctgatgtccgtatacgttgttgaactgctgcgttccttcttctacgttaccgaaaccaccttccagaaaaaccgtctgttcttctaccgtaaatccgtttggtccaaactgcagtccatcggtatccgtcagcacctgaaacgtgttcagctgcgtgaactgtccgaagctgaagttcgtcagcaccgtgaagctcgtccggctctgctgacctcccgtctgcgtttcatcccgaaaccggacggtctgcgtccgatcgtaaacatggactacgttgttggtgctcgtaccttccgtcgtgaaaaacgtgctgagcgtctgacctcccgtgttaaagctctgttctccgttctgaactacgaacgtgctcgtcgtccgggtctgctgggtgcttccgttctgggtctggacgacatccaccgtgcttggcgtaccttcgttctgcgtgttcgtgctcaggacccgccgccggaactgtacttcgttaaagttgacgttaccggcgcgtacgacaccatcccgcaggaccgtctgaccgaagttatcgcttccatcatcaaaccgcagaacacctactgcgttcgtcgttacgctgttgttcagaaagctgctcacggtcacgttcgtaaagcattcaaatcccacgtttccaccctgaccgacctgcagccgtacatgcgtcagttcgttgctcacctgcaggaaacctccccgctgcgtgacgctgttgttatcgaacagtcctcctccctgaacgaagcttcctccggtctgttcgacgttttcctgcgtttcatgtgccaccacgctgttcgtatccgtggtaaatcctacgttcagtgccagggtatcccgcagggttccatcctgtccaccctgctgtgctccctgtgctacggtgacatggaaaacaaactgttcgctggtatccgtcgtgacggtctgctgctgcgtctggttgacgacttcctgctggttactccgcacctgacccacgctaaaaccttcctgcgtaccctggttcgtggtgttccggaatacggttgcgttgtaaacctgcgtaaaaccgttgttaacttcccggttgaagacgaagctctgggtggcaccgctttcgttcagatgccggctcacggtctgttcccgtggtgcggtctgctgctggacacccgtaccctggaagttcagtccgactactcctcctacgctcgtacctccatccgtgcttccctgaccttcaaccgtggtttcaaagctggtcgtaacatgcgtcgtaaactgttcggtgttctgcgtctgaaatgccactccctgttcctggacctgcaggtaaactccctgcagaccgtttgcaccaacatctacaaaatcctgctgctgcaggcttaccgtttccacgcgtgcgttctgcagctgccgttccaccagcaggtttggaaaaacccgaccttcttcctgcgtgttatctccgacaccgcttccctgtgctactccatcctgaaagctaaaaacgctggtatgtccctgggtgctaaaggtgctgctggtccgctgccgtccgaagctgttcagtggctgtgccaccaggctttcctgctgaaactgacccgtcaccgtgttacctacgttccgctgctgggttccctgcgtaccgctcagacccagctgtcccgtaaactgccgggtaccaccctgaccgctctggaagctgctgctaacccggctctgccgtccgacttcaaaaccatcctggactaatggatccgaattcctcgaggcacgc

SEQ ID NO: 722 - DNA, 30 bp; single-stranded, linear; identical to SEQ ID NO: 549
  - 1..30: /note= "antisense oligonucleotide corresponding to positions 31-60 of hTRT"

SEQ ID NO: 723 - DNA, 30 bp; single-stranded, linear
  - 1..30: /note= "antisense oligonucleotide corresponding to positions 496-525 of hTRT"
gcgcagcgtgccagcaggtgaaccagcacg

SEQ ID NO: 724 - DNA, 30 bp; single-stranded, linear
  - 1..30: /note= "antisense oligonucleotide corresponding to positions 631-660 of hTRT"
gcccgttcgcatcccagacgccttcggggt

SEQ ID NO: 725 - DNA, 30 bp; single-stranded, linear
  - 1..30: /note= "antisense oligonucleotide corresponding to positions 646-675 of hTRT"
acgctatggttccaggcccgttcgcatccc

SEQ ID NO: 726 - DNA, 124 bp; single-stranded, linear
  - 1..124: /note= "sequence present in pGRN176 but not pGRN175"
gtggcggagggactggggacccgggcaccggtcctgccccttcaccttccagctccgcctcgtccgcgcggaaccccgccccgtcccgaacccttcccgggtccccggcccagccccttccggg

SEQ ID NO: 727 - protein, 1040 aa
  Modified-site 1..300: /product= "OTHER" /note= "Xaa at positions 1-300 may be present or absent"
  Modified-site 630: /product= "OTHER" /note= "Xaa at position 630 may be present or absent"
  Modified-site 649..663: /product= "OTHER" /note= "Xaa at positions 649-663 may be present or absent"
  Modified-site 674..688: /product= "OTHER" /note= "Xaa at positions 674-688 may be present or absent"
  Modified-site 701..706: /product= "OTHER" /note= "Xaa at positions 701-706 may be present or absent"
  Modified-site 771..790: /product= "OTHER" /note= "Xaa at positions 771-790 may be present or absent"
  Modified-site 887..937: /product= "OTHER" /note= "Xaa at positions 887-937 may be present or absent"
  Modified-site 965..994: /product= "OTHER" /note= "Xaa at positions 965-994 may be present or absent"
  Modified-site 1018..1027: /product= "OTHER" /note= "Xaa at positions 1018-1027 may be present or absent"
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXFFYXTEXXXXXXXXXXXRXXXWXXXXXXXIXXXXXXXXXXXXXXXXXXXXEXXVXXXXXXXXXXXXXXXXXXXXXXXXRXXPKXXXXXXXXXXRXIXXXXXXXXXXXXXXXXXXXXXXXXXXXXXXXXXXXXXXXXXXXXXXXXXXXXXXXXXXXXXXXXXXXXXXXXXXXXXXXXXXXXXFXXXDXXXXYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXGXXQGXXXSXXXXXXXXXXXXXXXXXXXXXXXXXXXXXXXXXXXXXXXXXXXXXXXXXDDXLXXXXXXXXXXXXXXXXXXXXXXXXXXXXXXXXXXXK

What is claimed is:

1. An isolated, synthetic, substantially pure, or recombinant polynucleotide comprising a nucleic acid sequence that encodes a telomerase reverse transcriptase (TRT) protein, or the exact complement of said nucleic acid sequence;
    wherein said TRT protein is characterized by the criteria that it has telomerase catalytic activity when complexed with a telomerase RNA, and contains an amino acid sequence that is at least 95% identical to the full length of SEQ. ID NO:2.

2. The polynucleotide of claim 1, comprising a promoter sequence operably linked to the sequence that encodes the protein.

3. An Isolated cell comprising the recombinant polynucleotide of claim 1.

4. The cell of claim 3, which is a eukaryotic cell.

5. The polynucleotide of claim 1, wherein said TRT protein contains a sequence that is at least 98% identical to the full length of SEQ. ID NO:2.

6. A composition containing a recombinant polynucleotide that comprises a nucleic acid sequence that encodes at least 100 contiguous amino acids of SEQ. ID NO:2, wherein the composition can elicit an immune response specific for SEQ. ID NO:2.

7. The composition of claim 6, wherein said nucleic acid sequence encodes at least 100 contiguous amino acids of SEQ. ID NO:13, wherein the composition can elicit an immune response specific for SEQ. ID NO:13.

8. The composition of claim 6, with the proviso that it is not a composition according to claim 7.

9. An isolated, synthetic, substantially pure, or recombinant polynucleotide comprising a nucleic acid sequence that encodes a protein containing an amino acid sequence that is at least 95% identical to full-length SEQ. ID NO:2, which can elicit an immune response specific for SEQ. ID NO:2.

* * * * *